United States Patent 7,745,391 (HUMAN THROMBOSPONDIN POLYPEPTIDE) - sequence listing, part 151

SEQ ID NO: 389948 - DNA, 158 bp, Homo sapiens
aaaagaagtaaattagggttatattagtttactagaagacatttcacaagattttttaagtgagaagcaagatgtagtgtaatatgtgtattataatttgtattaatctgttttcacattgctgtaaagacctacttgagactgggtaacattaagaa

SEQ ID NO: 389949 - DNA, 274 bp, Homo sapiens
ttatcacttaataactcacttattgcctataaaaaattgttcaggaaattcaaagtcgtgagagaatttctcactatccttcaaagtagttttaataaagtaatatcattaagctccaagttgaaatatagggtagaaattgtctgtctatattcctagactttaaaatgcttttcctatttaaaaaaacacattgtagtttccttgtaaaagattaatagggttcttgtgtaatgcagtttgacactttatagttggcctgcagaggcaagta

SEQ ID NO: 389950 - DNA, 407 bp, Homo sapiens
cttttcatcttccttcaccttctgaaacaagcaagtgtttttaccattgtcatatacaacactttgaaaatcagaaaatctcctgatcttttacttccataaaagtactgatttcctctcaatatatttaacataatatacatgcaaacaaaaagcacaaatccactgttagacttctggaacaagcataaataaacattcttgttatgatagtatctgctaagttaaaaatacccttttctagtaatgtcaaaatagaattattttgtagacagaatattaggtaggcatgtataaaccctgaactattcacatatactttaagtgtgcaaaaatgttcctattagaagtagaatgtgaataagggttttctgcactaggaacttacaccctctgtagacgcacaa

SEQ ID NO: 389951 - DNA, 1449 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggtatgcatggagaagagagggcacagctgtgcctcgtcatcatgaacctgtcctatctgtgtagttctttaatatgtcagcactcactgaataaatatacagtcacagaaaaagggcaatgaatggttatccggtccctcctttattaccgggtgatggagttgtgacatggtaatgttaaccggcactctgtgccagacttcccatgactttttatgccagacttttgttacttcccatggatttcttccaacactgcctgttacctgtggcacaaaatcaagaagcaaatagttcctgacctctaaggagtaagaggaacaggcagcattagtataaatgactcattgtcattaagctttggaggaggcccttgttttcctgtgcttactgcatcctagccatggaactgtggctaaaggagtgattatgttagccagatactgttaatggtacaacttgagagagaatagtatcttcttttttatttagtcacatgatgttccacatacatgtgttgagttcctgggccatgatatcctactagatactccagaataaataaaagaagtaaagtcatggactctta

SEQ ID NO: 389952 - DNA, 1054 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggagcctactcaatgtgaagatgacgaggaaaaaacctttactgggctccacttccacctaatgaacagtaaatatattttctcttccttatggttttcttaataacattttctttttctagctttaatataagagtatagtaaataatacacacaacatacagaatatatgttaatcaactgttattggtaaggctg

SEQ ID NO: 389953 - DNA, 533 bp, Homo sapiens
ggatataaaaatctgccgatgctcaagcgccttatataaagtggcagagtatttgcatatgacctacacatatcctcccatatactttagatcatttgtagattgcttatgctacctcatgcaatgtaaacactatgtaaatacagttgacccttaaacaacaggggattgaactgcacgggttcatttatatgtggatttttttccagtaaaagttacaccattatactgagtgtgcctgcctttcctgcttcctcttttacctccttcacttctgcctctgaggtggcccctgagacagcaagaccaacccctcctcttcctcctcctcttccttagcctactcaatgtgaagatgacgaggaaaaaacctttactgggctccacttccacctaatgaacagtaaatatattttctcttccttatggttttcttaataacattttctttttctagctttaatataagagtatagtaaataatacacacaacatacagaatatatgttaatcaactgttattggtaaggctg

SEQ ID NO: 389954 - DNA, 2992 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagctacttgggaggctgaggcgagataatcgcttgaacctgggaggcagaggttgcagtgagccgagattgcaccactgtcgtccagcctgggtgataagagtgaaactccatctca

SEQ ID NO: 389955 - DNA, 2471 bp, Homo sapiens
ctggaagggccgctccgcagttgtcagccaggcacatgtgtgcggaggccggcgtgcacgaggcgcgggccggcctttgtggcagagaaatagtgcacttcattggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctca

SEQ ID NO: 389956 - DNA, 3054 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggagaaccaggagaggaagcacaggacgtatgtctatgtgctcattgtcactgaagtgctggaagactgggaagattcagttaacattggtacacccaactttctcccaaaggagccattttctttgatctcagatggctgttacgtttacatctttggaactataaactgtggtggtacaaaggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctca

SEQ ID NO: 389957 - DNA, 1498 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggtatttcctgtaacttgctagttaacttagttttgtatttcaggcagaggtgcgctctgtaaatgttggggcccccccccttttttttttgggggaaaaacccctttttttttg

SEQ ID NO: 389958 - DNA, 207 bp, Homo sapiens
aaaaagtgttaagaaacattgctttaatgttttctatattttctcaaaagttctaggctcagaaaccttattactcttgtactagtttcttttctctctgcctccacaggaaggaagagggaatggtttaaaatagaagacgccataaaagtgctgcagtatcacaaacccgtgcaggcatcatattttgaaacattgaggcaaggc

SEQ ID NO: 389959 - DNA, 1701 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaag

SEQ ID NO: 389960 - DNA, 3115 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggccgcatgcctgtgtttccgcagcgagagcgaggaggaggtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctca

SEQ ID NO: 389961 - DNA, 2695 bp, Homo sapiens
ttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttgtgctactcgtgagcagtagtcgccatccagacagatggattgtccctggaggaggcatggagcccgaggaggagccaagtgtggcagcagttcgtgaagtctgtgaggaggctggagtaaaagggacattgggaagattagttggaatttttgagaaccaggagaggaagcacaggacgtatgtctatgtgctcattgtcactgaagtgctggaagactgggaagattcagttaacattggaaggaagagggaatggtttaaaatagaagacgccataaaagtgctgcagtatcacaaacccgtgcaggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctca

SEQ ID NO: 389962 - DNA, 2767 bp, Homo sapiens
cagggcccaggggcgggtggcgtgaccttggttcatcctcggccgcggagacgcggcgtgaccttggccaagtccccgcttccccatccgcagacttgcgcggctggaccgctcggtctccgctccggccgctaggcgtcctgcgccgctgttcttatctcccccggcttcctccgcgcaccccaccagttctacgcctacgctgccggcgtagcggtcgcctggagtcgcgcgtccctctcctttcagatgctggtttccaccgcgcgaactgggagggcgcgattcgcgaacgcggcctgcgctgcgagcgcgcggccgtcccgcaggccggtgcagccttacgccgctgacgcatcgcgcccaagatggcggcgcggtcgtcgtcgggggtggcggcggcagagggggcggcggccctggcggcagcggagacggcagccgtgacggtggcagcggcggcgcgggacctgggcctgggggaatgaggcggccgcggcgggccagcggcggagccgtgtagcggagaagctccccctccctgcttcccttggccgagccgggggcgcgcgcgcacgcggccgtccagagcgggctccccacccctcgactcctgcgacccgcaccgcacccccacccgggcccggaggatgatgaagctcaagtcgaaccagacccgcacctacgacggcgacggctacaagaagcgggcatcatattttgaaacattgaggcaaggctactcagccaacaatggcaccccagtcgtggccaccacatactcggtttctgctcagagctcgatgtcaggcatcagatgactgaagacttcctgtaagagaaatggaaattggaaactagactgaagtgcaaatcttccctctcaccctggctctttccacttctcacaggcctcctctttcaaataaggcatggtgggcagcaaagaaagggtgtattgataatgttgctgtttggtgttaagtgatggggctttttcttctgtttttattgagggtgggggttgggtgtgtaatttgtaagtacttttgtgcatgatctgtccctccctcttcccacccctgcagtcctctgaagagaggccaacagccttcccctgccttggattctgaagtgttcctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctca

SEQ ID NO: 389963 - DNA, 159 bp, Homo sapiens
tctctccaatgtgcatcctcttatgtatggttagtgctgagggttggctaaatgctttgccacattcttcacatttgcagggtttctctccagtatgtatcctcttatgtatggttagtgttgaggattggctaaatgctttgccacattcttcacact

SEQ ID NO: 389964 - DNA, 559 bp, Homo sapiens
tacatttttttattgcccatttgttcaaagagaattgtttgtaagtaaatgtatgaacaagataaaaaagaacattctggttgaaggggcaggaaaaattgtattatttctcacagttaatctgtgacatgcggaacacaaaatgtaattggtgagctattaactttttctctaattgtatattatttaggtttgtctaatacaaactggaatttcagggatatcaagatgctccatgaagaaaataattttaggtcaaatatgtttgaagcttaaaagttacaactttgtcacctttgaaagtataaagatactaagtttctagctcactttgatattaaatattcttaaatgtaaatttaaaatatatgtttttgccataggtttctcagtaaatacttattctccacattgctaagtaaaatgaagagtaaaatgtgcattaatgtaaatcaaagcacagaagttaagaaattgttcagaataatgaaagcaaaattaggggcaggctcaaatccctttactatcaatttctttcatttacatgattaaagtaatt

SEQ ID NO: 389965 - DNA, 771 bp, Homo sapiens
gacattaggaaattaccattcccagatgtcttctgaagctggcaggtaagaaatcccaggtaccttagtgccaagttctccaaatactctagatctatccagtgaactagatttaataaattacttgatttgggtggtagctgtctcacagtgttgaaggagagctagaggaaaatttcaaatctcatggccaaatgtgtgtcacctctttgtgatgagtgtccattgtgccccaatcctttgttagtgtgttggctgtccagatggtgcagtctacttggtttcccttctttaccagtccacgtgggcaacctctttatatcctctggagatgaaggatattccaatgaaaagaagggatgccttttgaatatttgaaatttcttgaggggaaaagtgttgctgtccttttatattgtcaaaggctgtgtcgaagttggagtcttagaattaaggatgcagttgtgtcactttgaatagaaagaatattatagctggaagggatcaacccttaaattttattttattttattttattttattttatttttttagacggagtctcgctctgtcgcccaggctggagtgcagtggcgcgatctcagctcactgcaagctccgcctcccgggttcacgccattctcctgcctcagcctcccgagtagctgggactacaggcacccgccactgcacacagctaattttttgtatttttagtagagatggggtttcaccatggtctcgatctcctgacctcatgatccgcccgcc

SEQ ID NO: 389966 - DNA, 336 bp, Homo sapiens
gttgttgttgttaaagattggacatgttagataatatattgtaggaactctggctagtgattccctttcctccccaggacttgtttttatttctctttgcttgtttactttttcatacagtctgtttccccacagtgtctgcctctgactttattccttagagggcgcagctgtggccatgtacgtagtcactctgggaagacagtggttttagcagcgtgctcattaactttctctgacctctttgttatacctcctgcctctgtggatattagacccagttattacatttcattgtttactgattggtctattgttttccagaatgccttggga

SEQ ID NO: 389967 - DNA, 754 bp, Homo sapiens
gtaatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaac

SEQ ID NO: 389968 - DNA, 162 bp, Homo sapiens
agttgcatttaagtgaggctcaggaccccagtgtgactccccttcaggtcaagacccctgcaacctcaaaagatagtttggcttgagcactcaagaggcagtatgggccagtgaggacagccgagcacccttggacaggtgatgccgcctctcagagcctca

SEQ ID NO: 389969 - DNA, 165 bp, Homo sapiens
agaacaaggtgagtgttatcctgaaacacagagaaggaagggattaattccaggtgcagggtaaataataaactgggctaatactgattgaacacctactaggtaccaaggactataccatgcattttacatatattatcccaattaattgccctatggaatatg

SEQ ID NO: 389970 - DNA, 312 bp, Homo sapiens
acacagctctcagtgtaactacctggcacacaccacacttctctgagaaggtttgattcatacttccccataccctagtggcaacaaaaggaaaaaaaccttgctcaggtcaggcgtggtagctcacgcctgtaatcccagcactttgggaggccgaggcgagaggatcacctgaggtcaggagttcaagaccagcctggccaacatggtgaaaccccgtctatactaaaaatacaaaaaggagccaggcatggtggtgcacgcctgtaatctcagctactcgggaggctaaagcaggagaatcacttgaag

SEQ ID NO: 389971 - DNA, 296 bp, Homo sapiens
ttgggaaagaaaagggaaaatagggtgtttgttactctagtcttcataaaagacagacaggggggttgtgtatccaatggagtttgattgatgtctgggagaaaattagtcggattgatcttgggaaagaaaagggaaaatagggtgtttgttactctagtcttcataactcaacaagtggctataatccttggtgttaatgaactattttgtttcattttaattatgtccagaattgttatttctagaataacaggttaacactggtcatttactttataacttttagattttgt

SEQ ID NO: 389972 - DNA, 582 bp, Homo sapiens
tggagagatcataacaataatgtttctggtgttagacatttcagaatgaatgtcgtaacctaggcagaaatagaatatggggagaaaaatatacttgtgcatgtatgtgcatacatacacacacacacacacaaaaaaatggccaaaaaaatgctgctaaagtcctagattttcagatccaaactgcaaaagttatcaactaccaaatgcagcaactagcattaaatgaatccccaaaactttataaatctaaaccttcttccaaccatgctttctattccttttccttagagtaacaacaaaatacaaagcgttagggtttcaaatcagccaatgacagtttacaatctctcctcatagccttttaactcagggaactctaaggtggtcatcagtttctattagcttcttaggctcccatccacctaattggctgaaattttctggaagcccacaaagctcatgtgtctttctctcaaaagggggaaatgcaactagcattggaaaaaactactaaagagggaatcctcaaggaacccactgaactctgtccctttattttcagttcttgaaaacaaggtg

SEQ ID NO: 389973 - DNA, 745 bp, Homo sapiens
gtttcttttttccctttttttaaatatattttcctccagaaagttgcagaagcttcctggtagaattgttataaggcataaatgaattattatatgtaaagtgaccagtaagtagattagttattactattattataaagtttttattcttctacactgcccattctattaaatatttttcagaaatgtgattttggctgggtgcagtggcttacaccttgtaatcccagcactttgggaggccgcagcaggaaatcacttgagtccagaagtttgagaccagcctgggtaacatagtgagactcctatcttggtaaaaaaattttaaataaattagctgggcacggtggtatgcatccatagtcccagctacttgagaggctgaggcaagaggatctcttgagcccaagagttcaaggttacagtgagctatgattgtgccactgcactccagtctgggtgacagagtgagaacctgtctctaaacagtcaaaaataaataaatgtgaatttcaagactgtttaatattctgtcatataaatacacagtaatttgacaaactattcttctgttggatattttaggttattttctttcctgtccttatataaataatattctgatgaactcatatctttgtctgtaactattttcttaaatataaggaatttcatgtaagtagatactaggccagttaatattttaagtattcttgatataaagacaaagtaccccccagaaatg

SEQ ID NO: 389974 - DNA, 273 bp, Homo sapiens
attttttctccaatcctttaacattcacgctactgggctttcatgttgaaagctgccagttaggtgtggggcccacccatatttctactttagaggccctctgatagcttcagagaagctgttctcaatgcagtcattttcttattttagagttattcatccaggttgggcacagtggctgacgcctgtaatcccagcactttgggaggccaaggcgggcgatcacctgaggtcaggaggtcacgaccagcctcatcaacatggggaaaccct

SEQ ID NO: 389975 - DNA, 384 bp, Homo sapiens
gccctgtacgccggcagtatatatgggagcggcgccgggcagacgggacacagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaa

SEQ ID NO: 389976 - DNA, 4825 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattcaaaaaaaaaaaaaaaaaaaaagggggggaaaactcagggggacggccttttaaaggcaagggttaaaaagggggtaaagggggagaggttgggaccttggtggccaagcgaaattgattgaggtaaaaaaaagagag

SEQ ID NO: 389977 - DNA, 2814 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389978 - DNA, 2653 bp, Homo sapiens
  misc_feature (2614)..(2614): n is a, c, g, or t
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttgccaatccacangggggccgggatcctctagaacgaccgcagcatcactcc

SEQ ID NO: 389979 - DNA, 4184 bp, Homo sapiens
aatatggcttggtcgggctgggttaatggacgagggtgggggtcgcgtatgcactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389980 - DNA, 5286 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389981 - DNA, 2171 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaa

SEQ ID NO: 389982 - DNA, 2986 bp, Homo sapiens
cgtcgacgtcagacaagagaaggagggcatattgtctatgaccaacttcctactcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389983 - DNA, 1575 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccggggagattagtaatttttaggtattaaagatacactcaaccaaagggacagaatgggaaaggctgaaaggggaatgaataacgttctcatcgttcaagtcattgccggtgccacacccagagaaaaacaagcaccacaccagacagcctctcagcaagccga

SEQ ID NO: 389984 - DNA, 2233 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaa

SEQ ID NO: 389985 - DNA, 5345 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389986 - DNA, 4002 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtgagccgtaatcatgccacttcactccagcctgagtgagactgtctc

SEQ ID NO: 389987 - DNA, 2651 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaaaaaaaaaaaaaaaaaaaaaaaaaaaaaaaaaaaaaaaaaaaaaaaaaaaaaaaaagaaaaaaaaaaaaaaaaaaacaaaaaaaaaagacaaaaaaacaaagaggaggaggcggcgccccgaacgagagcactcccgacggcagcgagcaaaaacgagcagccacctcaccgaaatgagagaaagagggcaacacaagacaggggcggcggcgacagcaacgacgagagagaggggaagaagaaaaagagagaaaggagcgacgggcgaagaacgaggcgcgtgggaggcgacccagaagcgagagaaagacgcaaccacggagcggggacgaagaaacaacgagggagaaagagaagaagagaaaaagaagagaagagacggagggcgcacgtgacgacagaaaggaaaggagagccc

SEQ ID NO: 389988 - DNA, 5053 bp, Homo sapiens
gcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389989 - DNA, 3496 bp, Homo sapiens
gccctgtacgccggcagtatatatgggagcggcgccgggcagacgggacacagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtattttcctcagcaatatacatgccttctcgataggttagtcccccgacaacaggagttcctgtggctggagccagtgtagggtcaaatgcatcaatatcaaaactcaaatggattggtctttgtctcctaaaaagg

SEQ ID NO: 389990 - DNA, 271 bp, Homo sapiens
cacgaatgcatttttgaccttgtatttctgacaaaactgtaggattatatgattgacattaaaggtaaaattaaaattaatatataaaataaaactcaaaattttcaagccatttggagcttgtcttgagctaatgaggtaaagctcatgtcctcaagaaaaatgttttactctgctgtttttaagggtgcttctatagaaagagtttgagaatcattaatatggattatagaaaattaataatgcttcatttaaaaataaatgtatttaa

SEQ ID NO: 389991 - DNA, 394 bp, Homo sapiens
cttgccttgtttttgggatcaccttattatgcaacatctgctctgaatttcaaatgtgataaacagagtatgagtgtcggtggcagatggctaatgaccagcagcgacagggcattcaagcctgccttgttttctgggaagcgatattttcatgttaatttgctctgtgtcctgcaaagatgagacaaatcacctgctcgtaattcaggcaaaatggagaccaccaggagctgagaggggccatggcttgattcctttaggagtgagaagagaagaagatctgagaggctttcctcatctgcagtacagggaccagtcagtcactttgcattatgtcaaactgagaaagatgaatcagccctgggcatcccatactgacatcagagccactgtt

SEQ ID NO: 389992 - DNA, 275 bp, Homo sapiens
gtgagccaagattgtgccattctactccagcccaagcaacaacagcgagactctgtctcaaaaacaaacaaacaaaaaaaaacctcaccaaaaaccaaacaaatgaaaaaaccagaaaacaaaagacttggggcatagtggcacactctgtaggcccagctactcaggaggctgaggtgggaggactgcttgagtccaggagtttgaggctgcagtgagctatgatcatgtcactgcactctagcctgggcaacagagggaaactctgtctcagg

SEQ ID NO: 389993 - DNA, 713 bp, Homo sapiens
ggtctggctctgtcacccaggctggagtgtgcagtggggcaatcctggcttactgcagccttgacctcctgggctcaggtgatcctcccatctcagcctcctgagtagctgggactacaggtgcacaccaccacacctcatttaaaaaaagttttgtagagatggggtcttgctatgttgcccaggctggtcttgaactcctgggctcaagcgatcctcccaccctggcttcctgaagtgcagggattacaggcgtgagccaccgcacctagccaaggttggagcatttttgcaaaaacacaaaggacgcccccttgcaagaggggctcatcaactctgcacagatgagggactgtcagatgcgcggatgaaagcacagaacatgtttttcagggaagaaacaaaatcttggcaagtgagggcacgtggggccaaggacgcctcctggcccccatccagccacgtgcatacagttactgtgtaggacgttcacagggtcatctgagtggtcagctgtgagttggttttggctttcctcttcacccctctttatggggaaaataaacaaatgaagaagctaaggtcctccaggaggacagggcctgcacctgcagggctggggagttcggtagagcccattccaacgctggcaacacaaccagcaccagatgccctgccggcccctgctgctgggtcccacggggttttagatc

SEQ ID NO: 389994 - DNA, 195 bp, Homo sapiens
agatttcacacaatgttgaacaaggacggtagctatcaagggttcacaatacttactattctctctacatgtttgaaagcttccataataaagtttaataaatgaaaaggctaggtggttagaaaaaaataaagtttaataaaatacatatagcagtctgacagaaagccacataaagcaggtggtatttaagct

SEQ ID NO: 389995 - DNA, 367 bp, Homo sapiens
tcaagaccccagcatacagctacactggaagggagctaaatttctattattggaaatagacacagtattgctgtcaggttggttgccatgccagctgtccaggtaccatgcttgatgccctgattaccacaagacttcccccttccccctgcttttaattatccttctgtagtgcagtgtatggtaactgatgggctcaaaactggcccacatttgccagtctccctatatgctcagcacttgaaaatgagtcttctctgctgtaatttaaagctagaaatccaaagacattgagtcaccagcataggtattttccacacagctgcaagtgaaacttcacaatggacttggccgctatttgcttaca

SEQ ID NO: 389996 - DNA, 845 bp, Homo sapiens
gttgaacacaggtgtttttacaagaggcacacaaaagagagacacagagagaagatgagaagactgaggcagacattggaatgacgcaaccaggagccaaggaatgcctggatccatgggaagcagaagaggctttctcaccatgtgatgcattctgctatgttatgatacagcaagaagggcctcacaagatgtgacctcttgttcttggacttctcagcctccagaatcatgagaaaaaaaggctcagcactgtgaagactgattgccacctcccccttccccagcaatctcgtggagatctggtcagagaagctgttccatctcccacaaacctcgtggctcagaagcagaggtggaggctgcagacctcatgtcaggactgggtcgactaaaataaaaacagtccccctagtctggatgccctgtgtaccttgcaactgagaaaatgtgaatgaaaccatgaaatactatgcagccataaaaaggaatgaaattatgtcttttgtaggaacatgaatggagctagaagccattattctcagcaaactaacacaggaacagaaaaccaaacaccacatgttctcacttataagtgggagctgaagaatgagaacccatggacacagggaggggaaaaacacacaggggcctatcagggggtgtggtggggggaaggagagcattggaaaaatagctaatgcatgcttggcttaagttctacgtgataggttgataggtgcagcaaaccaccatggcacacgtttacctatgtaacaaacttgcacatcctgcacatgtaccccagaacttaaaaataaaaatgaaaataaaaaatattagat

SEQ ID NO: 389997 - DNA, 814 bp, Homo sapiens
ggaatgagtgccctggaaggaggctctggggtggggagaagttggtctcatgggtccccaatttctttctttctttcttttccttccttcctttcttttttcttttcttttctttctttctttcctttttttttcttcctttttttctttcttctatttcctttcttcttttcctttattttctttctttctttctttctctctttctctttctctctttcctttctttttttgacggagtcttactttgtcgcccaggctggagtgcagtggcgcgatctcggttcactgcaacctccgccatccgggttcaagcgattctcctgcctcagcctctcgagtacctggggttacaggtgtatggcgcaacgcccggctaattttttgtgttttagtggagatggggtttcaccatgttggccaggctagtcttgaactcctgacattgtgatccgcccgcctcggcctcccaaagtgctgggattacaggcgtgagctaccgcgcccagccccgagttctttctagggtgggaggctgtgagtctgtgacatcacggggatattcttgggctggttccttgtctgtaagagcaacgaagggactttgtaccctgcaaagtgcaacttccggggatgattgggaagttgaggggttgaatgcattcacaccagagtcactctcagcccagactctccgggtcacctctaaggctgtgcactaggtgggcgtcagaggtattacaggtaaaggaatggcggctcagagggaaggagagacttgcctaacttcagggcaagctaacgcttgatttca

SEQ ID NO: 389998 - DNA, 349 bp, Homo sapiens
gatagtttatttgtatattattttatttataaatatccagcaggtcctagcaaataggaaaggaatatctacaaatgtttactgttttaggtagaagaatataacagtcatgtccaaactttttgaaagagcaaggatgtggtggaaggattgggaaagaactggcagttaagcctcagggaagtggcatttaaactgtcatccacagagccctaaggtttcgacagaggtgacttaggactcagtacagggaaggcaggggactctaaggtgggacactgagccattccccactatctttaacccaagtggctttacttattggacttctgggagtctgctgatattt

SEQ ID NO: 389999 - DNA, 210 bp, Homo sapiens
caggtgagcaggaaaaaagatgtgagaaagtaggttctgaagagagacagactagtgctaggaagggctgatctgcaaaggggtggagatttatatgcaggttttccaaaggaaatgccaaatggtatatttcttttaatcacaaagtagtgtctgcttactacagagagaactgaaactacagccaagcaaacagcaaaaacaagtaaa

SEQ ID NO: 390000 - DNA, 517 bp, Homo sapiens
aggtttatggggaagctgggtggggtggctcatgcctgtaatcccaacactttgggagaccaaggcagtcagatcacgaggtttggtggtcgagaccatcctggctaacacggtgaaaccgcatctctactaaaaatacaaaaaattagccaggcgtggtggtgggcacctgtagtcccagatactcgggaggctgaggaaggagaatggcctgaacccgggaggcagggcttgcagtgagccgagatcgcgccactgcactccagcctggtcaaccgagcgagacactgtctcgaaaaataaaaaataaaaaataaattaaaaaaagaaggtttatggggaaaaaaaacccagaagataaaaagatattacataaaatccataaatactcaagaccaattaaacagaatagagagcccagaaataatgccaccttcctacaaccatcagattttttacaaagttgacaagaagaatgtgggaagatttttctctgtaataaatggtgctggaataa

SEQ ID NO: 390001 - DNA, 406 bp, Homo sapiens
acacacacgcacaccaccacgaaatatgctatatgtatcttttcataatgtatttttaaaaaataattaaacccccttctctcttcagagtaaagatgatgttggcctattgtggtggctcatgcctgtaatcccagcacctggggaggctgaggcgggtggatcacctgagatcaggagttcaagaccagcctggccaccatggcggccccatctctactaaaaatacagaaattagctgggcgtggtggcatgcgcctataatcccagctacttgggaggctgagctggagagtcatttgagcccaagagatggaggttgcagtgagcagagatcatgccattgcactccagcctgagcaacaagtatgaaacatcctacaggagtgtgaaactccatctcaaa

SEQ ID NO: 390002 - DNA, 122 bp, Homo sapiens
gtgctttattggttgtccctgaggactttagccctctctcactgcagcacagacactgtgctttctcctagtttctgtggcaagtgacaggagcccacctcaaactaaagcaaaagggactt

SEQ ID NO: 390003 - DNA, 386 bp, Homo sapiens
gtgtgtgtataaaatcacctacaaatgctcctgtagcccaggaaactgtttgaagactcctgggagatagttagggctagcatgggcctgggagccacactggccccaccatgtagaggcttatgagtcttggtttcctcctctgttgcatggagaaatgataacgtctacctcataggattgttgtgaggattaaatgaaagaatcccaacagagtgactggccctgtggctcaaaaagtgtgttcctatttccaatatcaccccactctttcctgcttatctaactctctggcttcccccgtcagtccagcaatacctgaattttctccctttttcctcctctgtgatgtgagagtttccttttgctatacagaccccagaact

SEQ ID NO: 390004 - DNA, 133 bp, Homo sapiens
tttattgtgtcacttcatttaatgagcacgtcaatttggtaactaaaaataataaaaccttaaaaaaaaatagaacaataggccgggcatggtggctcatcccagcacttttggaggctgaggtgggcagatc

SEQ ID NO: 390005 - DNA, 448 bp, Homo sapiens
caagcaactgattataaactgaaccaatctcatcatggcattttctaatagaaaacttttcaaaggcttcccattgcttataggataagcttggactccttaacctggctctaaaggtcccacacggtctggcccccacctgcctctctggcctcattctattggcttatccccttgccacactctgtccacataagcctcttttcatttaccacagaagccatgttttctcctgcctcagtgcctttgtgcatgcagcccctgctgcttgcaatgttcaccgccccctttttttcacccagttaattcctcctcttctttcaactctcaggaaaccactgggcagagggcactccagcctgctgcccatctccttcttagttttacataaaaggagggggaactgatggtaggattacttagtgccagtgagattgcttgagacgtg

SEQ ID NO: 390006 - DNA, 522 bp, Homo sapiens
gatcttaattttgaaattgacatgaaagtgtcatatcagtaatctgtgaaccaccagtccttggtacctatcagagggtcaaaaatcacgattaaatataaccaaaaaactttatagtgactgattcaaatttgaatactggttttagctaatgtagtagtaatgaactggtttgggggtaagatttttctggtatcttattgctgtagaaatttttctttaacagttacagtgttttcttccaaatccttcacttctctgtcctggcttgtaaagaaaacatctgaggactgaggggtcatatttgaattgctctttataataccatagactactcattgcttagactttactaagctagaaatcacaagagcataagctactcttaaaatttatattatgagaatgtaaaagatacctgacttcaaatatcttgaacctcactttggctcaagttttctgtttaactttttctttaatactgatattttaatttttacaacagatacatgatttgcaaaa

SEQ ID NO: 390007 - DNA, 434 bp, Homo sapiens
tacatgtgcagaatgtgcaggtttgttacataggtatacatgtgccatgatggtttttaaaagatgattctagcttcatatagagaacaatctctgtggagaaaggagatatcttttgatgaagggagactagttggagcctagttcagtatttcaggaaaaggataaacgtggcttggataaagtggtgggacttgcaatacaacttgagatatgtctaagaagtcgaaagaaccagatttgacattcaactggatgtgagggatgagagaggtgtcaagtataattttcaggtttttcacatgagtaacttggtgaattttggcatcatttactgagaaagaaaatgccagaaaagggcctatttgacggggcaaaggaaggttgtgagaatcagaaagaagatgatcaattcagctttgcaaatgctgaat

SEQ ID NO: 390008 - DNA, 383 bp, Homo sapiens
atggatcattcactctttcatgattgtgtgaaatcgtgcatcattcaattagaaatattggttcagtgagttatgtaactcttttaagcgtcgacacatttcattatctaagatcaaaaaatcacattcattagtatcatcaccaatcctatcaggaatgccttaagtattgggaaatatggagacacattttccaacgttgacaattttccaaatttgcttgaattttatcattggccaaaaacactgtcagttcttgaagtggcaggctcattgcatttattatctctgccatcattggtctgtcagtacttcttccatgtaaaaataatgttccatgaaaaagagttgctggttcagctcacagttgaatctcagatgca

SEQ ID NO: 390009 - DNA, 273 bp, Homo sapiens
tacttactggcgtgcagatacttcatagccgtgaaaacataaggtcactgacaaagtctgagtagcgtgggtccacctgacctcagcgttgtccattttctaaagtgatcatcactggactttgaaacacaggtggtgccctccaagccacctgagtgatctgtccccagaattccctagtgaccatttcaggactttgggatcctgtgtgtagtccccataattctgactgcttctcttttacattataaaagtcttacgttttcatcatta

SEQ ID NO: 390010 - DNA, 208 bp, Homo sapiens
gaggagaggggctgtggggacacccagatctctcaagattgagtgctggctgaatgtaggaactgatctttttggggggctggtgggagaagtccgagtgaggccctagagggtctcccggctgacttccttctcagaggcctgtggcccttccctaaccttccttcaggaggtggggtgtgccccaggctgtggaagggccagggga

SEQ ID NO: 390011 - DNA, 321 bp, Homo sapiens
taactttttattcctcattagtaaatctcatctttcaattgtaataacctacatttttggtgggaagtttctatcttttctttttagtagtattccttccttttggtatatataactagcattcatggctgatagataacagagcaccaaggacataggtccaaaattttaaggacctgcctaactgtatagagttcatacttaagagctgaatctgtaatcaagtaatctttgcaagagtttttattcacaatgcaatctagataagagaatgtgaatggggggcccagaccagcctactgctacccatagaaaactgat

SEQ ID NO: 390012 - DNA, 715 bp, Homo sapiens
tgcagtgactcatacctgtaatcctagcactttgggaggctgagacaggcagatcacctgagcccaggagttcgagaccagcctgggcaatatgaggaaactccatctctagaaaacacagaaaaattagccgggcatggtggcgcccacctgtagttccagctactagggagactgagatgggaggattgcttgagcctggaagatcaaagctgcagctgagtagtgagcatgccactgcactccagtctgagtgacagagcaagaccctgtctcaaaaaaagaaaaaaacaaaaacttgtaagtaaagagactataatcaaagtcagataaaaagtacccccatatttgtcactgcacttaaagtatgctttggattatctttataacttagtccatcttccttaaagtatcctcattttgatccatactagcagtgtccatcagcatagcagatgcacaaaatatttgttgagcaaaataaaaaccactgctcagaggcagaaacaacccttgagaggatacaaaagcttacctggaaaggggagctttaaaaagactgcacactttggacataattgtggaggactagcctagaaatgtgtaagtggagtattagcttctcagcttctaaagagtaactgtggctgggcaacggtggctaacgcctgtaatcccagcactttaggaggccaaggctggcagatcacttgag

SEQ ID NO: 390013 - DNA, 472 bp, Homo sapiens
ctctggcagctatggcctgccgggggcaggggtggcagcagggagaccaggaggggctgctggagggagcccgaagctggatgggaacccaggcttaagtggtgggaggggacccaggcttgagtggtggcagaggggtaagaggtagccagatcctggacactttcaggaacttgagtcagatctgccagtgagtgggtcgtgggatgtgagaggtggaagaataacctctgaatagataaaacatacaggctaatgcctgctttacagatgggaaaactgaagctcaaagagctgaagtgacttgcaccaaggtcatttagttaggaagttagtgaagcaaggacattcacccaggaattttcactccaggctccatgactttccctcgtccatgtttcaagtctcttgcccctggcctctgccccccatctcctggccaggactgagtcagcccacccatgagcgcttc

SEQ ID NO: 390014 - DNA, 257 bp, Homo sapiens
tagctggaactgcaggtgtgcaccaccatgcccggctaatttttgtatttttactagagatggggtttcaccatgttggccaggccgatctcgacctcctgacctcaagtgattgacccacctcagccttccaaagtactgggattgcaggtgtgagccaccacacccggggctggatttttttgttttaagagacaaggtctcacactcttgcccaggctggtttacagtggtgcagtcactgcagccttcacctc

SEQ ID NO: 390015 - DNA, 321 bp, Homo sapiens
agtttgagtttaatgtgttatgcagaagatcttttagcatagtatctgtttgagatctctgagctttccatatctagatgtctaaatctgttgatagacttgggaagttttcagatactatttaatttgttttgttatccctttcattttctctttaccttctggaacactggcgaggctaggacactggcgaggctaggacactggcgaggctaggacactggcgaggctaggacactggcgaggctaggacactggcgaggctaggacactggcgaggctaggacactggcgaaggctaggacactggcgaggctagga

SEQ ID NO: 390016 - DNA, 269 bp, Homo sapiens
tctctttcatattaaagtttgggaaggcaatccagagcccatatgacattatgcagggtcagggatccgggttctttctatattgttcctccccattctcaacctgtggctttttttttttttcttttaatgagatagggtctcactctgttgcccaggctggagtgcagtggcacacttctggctcacttcagcctggaactcccgggctcgagctatattctcccactttagcctcagcctccagagtacctgggactacaggtaca

SEQ ID NO: 390017 - DNA, 389 bp, Homo sapiens
tatcaaatacagggttgggtatctctttgtaagagatagcagtgattttcagtggataattaagggaattagcacttcacatttttttcatgatatttttatgtcacttagaatttttcacgaattattccttgtatgattgtagataattaaagccccatatgctttgcagtagtagcagcagcgcagattatgatgcagatggaattggtaagagcagtaggttttgaaatgaggttgtagacgggctgctgagactgatttttggacagcataaatgaaagcagtattctgatgtcagcatttggagtttaaaaatccctagccatggatcctgtgctgagtcattggtacttcaggtaaaccaattccaactctatgtaagctag

SEQ ID NO: 390018 - DNA, 430 bp, Homo sapiens
atgacacacctatgaggcagttttagcctatcttaatatactgaaattcattagctatctgtttgaagtgagagaaaaacttctgtgaagagagtaactgtgctacgttgcagtgccctaaaatgtaattccaggctgggtgcagtggctcatgcctataatcccagtactttgggaggccaaggccggcggatcacttgaggtcaggaattcaagactagcctggccaacatggtgaaaccccatctctactaaaaaaatacaaaacaattagccaggcatggtggtgggtgcctatagtcccaatgactcgggaggctgaggcaggagaatcacttgaacccagcaggcagggttgcagtgagccgagatcgcactactgcactatagcctgggtgacagagcgagactcagtttcaaaaaaaaaaaa

SEQ ID NO: 390019 - DNA, 436 bp, Homo sapiens
aaaataataataaaaagagtctataatggtaagaggccctggaggatgagatgaatgctgagctgtgtgtctgggcatgtattttgtccacacctaatcctttctgtcatgttttaactactccttagagtggaggtcagcagtgtctgattacctccagagttcctctctcttatcgtatcttgtccctcgctccatttccttttctggcattattggacagcaagtgttacaacttaaaatcaatacgaagcaatttcatttgtttataactatgaagatgagcgcttccagcagagcactgtactttcaagtaaagtttaggttttttttttttttctactttttctgtctggtgcccaaaatgcattaatttttcattgtacgagtttgcttatgttatcccgctttgatctaaggccttgttaccatcatc

SEQ ID NO: 390020 - DNA, 1359 bp, Homo sapiens
ccctcaacagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccgcaccctctgctcagcccctggactcagccttgcctgtcttttcctgctgctcccagggggaggtgtcagacctcgggaggcagacgggaccagagccaggctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaacacagggatttcccctctctagatccctgccaggtccctctccaggaggcccctctgctctcctgaagggtggtccctgagggtctgaccagccttggcacgagaggttggttccagcccctggcagggcttccttccaagggcccctgcagcctacaaactgggcctcgggcgactcaaaataagtgctcttgggggtggctctaccccattacctccccagccacaactctggccttcgacttccggctgggttagccagaccctggtttctctaccctgatgttgcatgagacctgg

SEQ ID NO: 390021 - DNA, 529 bp, Homo sapiens
gtgctaggattacaagtgtaagccaccatgcctggcctcttttcttttcttttaaagggaggctgggaaagccggagagctagtaggagccagggcacatagagagtgaggtagtagcatgcctaaggtacacctcagcagttccagaattctgctgcgagtggtcctccatcaaactacttcacctctctgaagtctagttcgcttacctgtaaaggaaagataataaccaactctaacctacttcaccaggttgtcaaggattcaaataagacacacatctgtaaaagcactttgtatgtcttaatggaaatgttagatattgctttcacatatgttacagataactggctattgtttcaatcaagtcagcggttctaaactttggctgcaaattagaagcacccggaagcttcaaaaaatccaaatgcccgggccacaccataaactaagccagaatctcttccgtgggacccaggcccagtactactttgtgtgtgtgtgtgtgtgtgtgtgtgtgtgtgagatg

SEQ ID NO: 390022 - DNA, 462 bp, Homo sapiens
caaaaatgcatttaatatgcctaacttactaaacatcatagcttagccgagcctaccttgaacatgctcagaacactcatataagcctacggttgggcgaaatcatctggtaacacagtacactgtagtgtattggctgtttacccttatcccatggctgaacgactgggagctatggcttattgccactccccaggaacacaggagagtatcactagcccaggaaatgatcgaaattcaaagtatcgtttctacttaatatggattgctttcacaccatcataaagtttacacattttaaagtcaaaccatcataagtcagaaactgtctgtagttatacatagcagtcctcatgaatacattaatgccattatcacaggaatgggttccctattgtcagagtgggtttaccccctcttgttcattctgtcttttcaccatgtgatgccttctgtcctgtt

SEQ ID NO: 390023 - DNA, 455 bp, Homo sapiens
gctaaagatagggatttttaagaggagcaaaattagagcaggattatgtgctgcctggaatgatacagtagataagggatgtaatctgaatctaccgcataactgaaggagttgctcttagacaggaacacaattcatcaatagtaacaagagtagagaccacatatatggcttcaggtacaggtaggaagagagacatgatggtggaatcacatggaagctttcttctcatttattccattttctcagcaaaatacaaagccaggtcattgacgaaagtgaggatgggggaggaggacttgaacatgtgatgagagaggagaaacaactgtgaatggtcctctaggaaagtggagaaggaaagaatcagagaaaatagtgtgattatctggaagcatgaaaggaccaactctgtggccctgaacctcaagtgagaatgctgagcaagtcgtgca

SEQ ID NO: 390024 - DNA, 260 bp, Homo sapiens
gcttaccaggtgaggttgctgactttcttctctagagtctgtagagtagagtatctacacaatattccatttgtgaaaatttgcacaatagactagataaacaacggattacggagaaaacagccctaatactcagaccctaaagcagtgctaggttaacaacaaggtgcttacttgcttggggtgccagccaaagtcagaacaatgaggctttcatggacttatccagaattttataactgataaaaagaaatcatttt

SEQ ID NO: 390025 - DNA, 319 bp, Homo sapiens
aatgttaaagatgacccctgggagtaactagcactacgggcatgtgcccccatcttgagaacatgccatgatgcacagacagaaggtatactaggtggtgcgtgcacaagtgaattactcccccagatccagccgtatgtcatatagtacacatggaggggtcaccaagatattacggcacaggcaaataagacacagtaagcattatcatttccattttcaagataaggatattgagctgaggtcacttgcagagttggtaacagctgaaccctgagctaacgactttgtcttgcacttgaaaacctgtttctctccc

SEQ ID NO: 390026 - DNA, 224 bp, Homo sapiens
agaccggctactgaggctcccagcacgctctctccacacatgatctcccctctgggtgtttgggtttttctgtgttttcatctttttttttttaaacctgttcagtgctgccagtcaaccgagggtctgtgagtggcagcgtgggatcaggcagcagggatttttccccacctccccctgctttggttccttctcaggactgagccaccgggctgtgggggaag

SEQ ID NO: 390027 - DNA, 577 bp, Homo sapiens
tgcaaccttgaccccaggacttaagcgatccttccacctcagcctccctagtagctgggaccacaggcgtgggccatgatgcctggctaatttttgtatttttagtagagatgggggtttcaccatgttgcccaggctgatctcgaactcctgaccccacgtgacccacctgcctcagcctccctagtagctgggaccacaggcgcgggccatgatgcctggctaatttttgtatgtttagtagagataggggtttcaccatgttgcccaggctgatctcgaactcctgaccccacgtgacccacctgcctcagcctcccaaagtgttgggattacaggcctgttataagttttgatgttgaaagcacaaataagtctttgtgcttagagagaactggtctctacaaaaacaagaaaaaaaaatcagccaggcacagcagcatgtgcccctagtgccagctactgaggaggctgaggcaggaagatcaccggagcccaggagtttgaggttacagtgagctgtgatcactgcactccagcctgggtaacagagcaagaccctttctcaaaaaaaaaa

SEQ ID NO: 390028 - DNA, 1214 bp, Homo sapiens
aataataataaataacattaaagttaaactcgactctaattttcagtttacagaaaataaggatgatggaagaacaagctaaatgacaccatagatgctaactggaaaaacgtacctattaaaaaaggacattgctgtgacaatcaggaaaagttgaacataaagtggctatcaaatgatacaataaaattgtcgtcaattttcatagatttggaaatggagttatatttaaaataagttcttaactgtcagagatactactgaagaagtataagtgacatgataggatgtctgagacttcttttaacatgctacaggggtaaaaggagtgtgaaaggtaacaaaaagggcaaaatgttggctgatgcacatacggatacatgcatacaaaatgctgactgatagatatatggagggggttgttatattgtttctctaatattatgtacatttaaaaattgccataaattttttaaacttaacaaacaaaaaagacagaaatcacaggggaaaaaaaaaaagaatgagttcatatctggaagagcaattaaggatttttttttttttttaatatttctaacctgaagtcacaaaacctggtttacaaacagggctttgctacttacaatctggcctagataacctaaatcaatgtatttgtacataaatacataaatgtccatatctgtagcatgaaaataattgacttacctactacaaaaatatatagtatgtaaaaattaactataaactaaaaaaaataaaatacagatatcttcaatatattttgtgtttaccttcatgtcacatgtgtatgcattatctcttcaaccaaatagtaaggtctctatgagtgaagtccatgttccattcctttaaccagcaaacattcaatgtacacttctagtcagtctactacgtgtcaggcatttcttactaagaggttaagaacacaaaggtgtaagtcgtaggctgtggaatcaaatgcagagatggagtaagatacataattattatgattcatactccaaactacataagcaaagaggcaaaacagttatgtggccaggtctagagtgaggagaagctttctagaggagggaatgtatgagccatatataaacatggaaaaggtctgcaaaactcatgtaggaagaaaaaagagtcccaggcagaaagaccaaaaaacaaacaaaaacaaatgaaaaaaaagc

SEQ ID NO: 390029 - DNA, 356 bp, Homo sapiens
acctcctgggttcaagcaatcctcccacctcagcctcccaagtagctgggactacaggcatatgccaccatgcccagctaatttttacattttttggtagagacagtgtcttgccatgttgtccaggctggtctcaaagtcctgggttccagcaatcaacccacctcggcctcctataaagacgtgagccactgcaggaggctgaggcaggagaattgctgacatatccagtttcttagaaaaaaacatttaatagagacttacaaacagaagctatgtctgggtctcaggtggcagtgagacaagatggtagctttaccccccaagaccaagggccacaggggaggggtgacctc

SEQ ID NO: 390030 - DNA, 304 bp, Homo sapiens
ggcgttgttattctgtgattaatgttactgtcatgggaaccaagattttaagcagaagaggaaagtgatacaaacaaaatcaaagattttaagtaaaaatcctgtaatttttttttttttttttgagatggagtttcgctctcattgcccaggctggagtgcagtggcatgatcttggctcaccacagcctccacctcctgagttcaggcgattctcctgcctcaacctcatgagtagctgggattataggatgcgccaccacacctggttaattttgtatttttagtagagatgaggtttctc

SEQ ID NO: 390031 - DNA, 413 bp, Homo sapiens
gccgagggaaacacaataatgtttgtcagatactgtgtaaactattagctcaaggtaattcacaatttcaatgttagatttcactacattccttttgataatgtcctatctttgtgaagctgagttttccgaacttgctgtataatttggaatctggataaataatttctctattttatctgatgctttttctattttttaaaagtgtttttcatctttcactgtattttccatttatttgcagatagaaacagactaaatgtgagtttgaggaagccctgaagccagtttcaagtatatggtgacatctctctggtggtcaggtggacctgatttttttctatatagcatttcacagtgagtatttttcttcctgtgtcttagccacaatttttaaaatgttttcttttttt

SEQ ID NO: 390032 - DNA, 825 bp, Homo sapiens
aaaagtcaccatttaaggggtctgcagtccaattcatcagttgtctttagtttactcagcatcagctactaacatacctgaacgaagatcttgttctaagacattgtatgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactcattgcaagtata

SEQ ID NO: 390033 - DNA, 859 bp, Homo sapiens
ttttccttttagtatccaattatctgaaacttaagaagagtgtgcaccgcccaatgggtgtgtgtatgtgctgctttgaacctatagttgagatccagagaattgggagtgacatcatctgtaacaataaaagagcctctcttgtgaagatgatacctgcaaaagacatggctaaagttatgattgtcatgttggcaatttgttttcttacaaaatcggatgggaaatctgttaagaagagatctgtgagtgaaatacagcttatgcataacctgggaaaacatctgaactcgatggagagagtagaatggctgcgtaagaagctgcaggatgtgcacaattttgttgcccttggagctcctctagctcccagagatgctggttcccagaggccccgaaaaaaggaagacaatgtcttggttgagagccatgaaaaaagtcttggagaggcagacaaagctgatgtgaatgtattaactaaagctaaatcccagtgaaaatgaaaacagatattgtcagagttctgctctagacagtgtagggcaacaatacatgctgctaattcaaagctctattaagatttccaagtgccaatatttctgatataacaaactacatgtaatccatcactagccatgataactgcaattttaattgattattctgattccacttttattcatttgagttattttaattatcttttctattgtttattctttttaaagtatgttattgcataatttataaaagaataaaattgcacttttaaacctctcttctaccttaaaatgtaaaacaaaaatgtaatgatcataagtctaaataaatgaagtatttctcactcattgcaagtata

SEQ ID NO: 390034 - DNA, 379 bp, Homo sapiens
ttcatgatcagcaagcaaatttaccgtatttttatttagaaataaattaaccagggaagtatgtggttctccctcccctacccaccacttttagttgcacagaaaaattcatccttgtcactacctgtgtccaggtggtctgcatcttcagaactgtggatatggataattggaataagattacttttgcaaatataaaactcatcagattacccacttgaaataatgtaatttgaaacacttgatagtaatttttgccccataaaaatcctacgtgtttgaaccttttgctgtttgccttgctcattttaaaaccaaagtttgtttagtcctatagctaatgtttgtcataggcagcatttgttacaaaatgatttta

SEQ ID NO: 390035 - DNA, 2224 bp, Homo sapiens
cagcaattctcctgcttcagcctccccagtagctgagattactggtgcacactgccacgcctggctaattattttagtagaggcggggtttcactgtgttgcccaggctgttctccaactcctaagcccaggcaatctgcctgtctcggcctcccaaagtgccgggattacaggtgtgaaccgccacacacaaccccaatttttgtttaaaatttgcatccacattaacaaaacttttattagaaaaattcatttaatatctaggcaaaattatatcactttcaaaactttttaagtaaattcagtaacatatcaattcagtttattagcatcaaatttgatgaagcagtgcataaatggaaacaaaacagtttatcaatacaatatatcattcttcagattttgcttattttttgcagccatttattacatttaaaattttgtgcatattgtctcatttgaaaaatgtgagttattctgttttatttgtattatgaaatgtttctattgtaaataaattcttttacctgtctagccaggtcacaagtttttcccattttaggagcttcaaatttagcttgttcatatgcagcgtgatattagggagaaaatgtgaatcacagtgctactttttgtctttgattgaatatttggtaagcatttcttttgtttcaaggaaatcttgaattggattttctagtacaggaaatccttataaaattcttttgtaagtcatccaggtaacattggtaaagaaacaagatcattagatacattgtcttttttttcagaagtttcataaactgtcaacattctatagcttttgtgcatatgtactgaagaattataacacatgtatccgtgactcgttcttggagtctgcttcagaaaattgaacacaaatattttcagtatgtatcatgcatagaatagagcaatgagggaaaagttatcctcttgctttaaaattccaacatggatggtcttttgacttaacttagctggagttccatccttgtgatagaaactaacttttctgtctctaactgaaattctttgacagatggaagattgtcaaaaatatctgccatgagtttgagcctttaggcaatgaattcacatttcattgcctttacatgaatcgacattgtaaatttggaggttctttgagacagaatatacccagagttttctttgggcagtgtcttgtatcaaacagttcatctaaggctaaagaaaaatacttgaaatttttcaagatttgaattaattggtctttattattaaaatataaatattctattagcaaaaatatattctgttcatgtatatccaagagcaaaattgtttaatggtttcattgacgttttcagttttcatgaatgtcttttaaggtcttttcctcataattttctaaatacgataaagtgataatttcttcatctctccatctaaggttctttgtagatgcatgtgtaagaagctattttatagcttgccaggtttacaaactcagacccttttaaaagttgtttaaattgttttgttagaaatttcactcgcagttcatatgagtaattttgtgtattcttttttgacttacactcactaaatggttgctaaaaattacatgtcttaaatattgtcttaagtattatctactatgtatctttaacacttttgaatagaacaaacagcttttccattttgctctgctgcagtaaattgcaattgccattcatcattaaatgtgcactatactgtctctagtcttcttgactatgccagttgtagtaccagcttctgtatctgcactgaattctgcctcagtaatatgcctttgtttaaaatttaaatattttttcatttttttaacctagaaaataattataatgaaaatattaagtatctcattttaggattctgatttacataggtatcactgtaacttgtgctgtttgcataggtatactctatcttgtgctatctgcataaaatatccaagtaaacacattgtgattttacatccgtgcatagaaaaaaaaatcatctgaactcaaatcaatctgttgatactgactagattggtgacgtgtttatgtgtaacactagtgataatgcacgttcctgtacaagcattataatacaacagtgtcctatgcaatgcagtggttaaagtgaattgtagttctatcaaaataaagatacgtttagtggaaaaaaa

SEQ ID NO: 390036 - DNA, 173 bp, Homo sapiens
gaagacaatactgatgccagctctttgtaattgtgaaatctgtacccaaacctctggattagaatctccagttgtctactgtaaatactggaattacagcaaaggatatggggactgggctgcttttctgtattgtacaagcactattctagatattaaagaaatttaaccgc

SEQ ID NO: 390037 - DNA, 143 bp, Homo sapiens
cttgtaaatttgcgttttctggcatctcctaggtgatactgctggtcttggggactatcgtttgagagctactgctctggcactgcaagcctggaggtggctctcagcaggccctcctattagcttttgaacatttggacttt

SEQ ID NO: 390038 - DNA, 305 bp, Homo sapiens
tatgagtgagcatgatctggtgatgagcatgggtaacactgaagaactgtcatttatctttccataacgacaaggcacatgacctgtttgcaacttttctgtagtttcagaatgtacactcactcctcatcaactcttcagcaagcccgctccataggacaagcctcagtctactgtgactcaaggaaggcatgaaatccacctcaacgtcattgtcccaaaagttcgctgtattgttctgaaggaacttgtctcaaccagcctggggaaccctcatctcacagatcactgaccacccgcatccc

SEQ ID NO: 390039 - DNA, 370 bp, Homo sapiens
tgagagctggggccagtttgattcagctccgtgtccccagtttgccatctctcctgtacttgctaggtgcccagtaaacatttgctgatagaatgaaggaagaaaagtctgataaactaattgagatggtgttactgtgatttaatatgtcatcccacactgtgagctactttttaagttccagggagaagataagatttaaatcataatttaattctaccatttaatcgtaatgatagaattcaaggacccatgataagtaggtgggatagagacactgaacaggtgtgaattctacccaaaattccccagatatctacgttggtacctgggggctctgccagccacagtcaagtgcagctctgcagag

SEQ ID NO: 390040 - DNA, 531 bp, Homo sapiens
atagatggagtcttgctatccatctatggagacagcctagttgcccaggctggttttgaactcctggcctcaagtgattctcctgcctcaccctcccaaagtgctgggattactggcatgagccactgcaccagcctcttaaagcgcctttaatcaataggttccctgcctcttttcttgtttatcccccctacctcttttttatttgtggaggagtctagtcatttgttccccggagcttcccacatgctggattttgctgactgccttcctgtggcaatctgcgtcttcatccccagaatttccaggacacttgtagttaggtctagaagctggacttgattcaggcttaatattttttagtaagtatacttgatagcaggtggtgtacacatccatcaggaggcacacaatgttcagttgtctctcttttatgacacaaacagtcactgatgatcattaactggatctattctttcaataacggtttgtaaaatggtaaaattctatcattccctcttcatctataag

SEQ ID NO: 390041 - DNA, 680 bp, Homo sapiens
ggtcaggttgcagtcctgatcagtcaggcattcaaactggactgataattatcaaagtggaagttcacagaaagagttattataattgaggaagtaaaaaatcatgtaacttccacattcaatactgtaatttaaaaatagatttttttcacaataaccatatacaaaataatgtatttaacacataaaaccaacaagagaaaacccacaattctttctgatcacacaaaaatctatttagaatgttaaaattattattttttctctatgcctttgttgttctacttaaagtatacaaacatcatactgacatagattacttattcacttaccaaaaaggagatgtagacaatagaacatctaaattgactgaaaaatctaccaaggcttttatatttaaatcacaggcaaaatggtacatgttatcttcaaattagggtgactaaacattttggtttgcccaggactgtcccatatttggcatgggaagtcccatgtccacaacacccctcagttccaggccaaacaagacagctggtcaccctacctcaaacaacagcacaaacaaccagaataattatgttctttaaactctcaccttatatacaatttataaataataacaatgaattcattgaataaagaaataaaatattgagttggctattttacattataga

SEQ ID NO: 390042 - DNA, 287 bp, Homo sapiens
aacacatggacacagggaggggaacatcacacactggggcctgttggggggtgggggctagggaagggacagcattaggagaaatacctaatgtagatgaagggttgatgggtgcaacaaaccaccatggcacatatatacctatgtaacaaacctgcacgttatgcacacgtgctccagaactcaaagtattatatatatatgaatgaaggtagattttatttaataagctaatttcttgtagtctatattattgcaacaataaaatatatataaagttgaaaaaa

SEQ ID NO: 390043 - DNA, 328 bp, Homo sapiens
caggacgtagccttccgggacgcattactagggcgacggccggacgcctccgcgttacgggatgaattaacggcgggttccgcacggaggttgtgacccctacggagccccagcttgcccacgcaccccactcggcgtcgcgcggcgtgccctgcttgtcacagaatcatggtgtcatggaaagggatttactttatactgactctgttttggggaagcttttttggaagcattttcatgctgagtccctttttacctttgatgtttgtaaacccatcttggtatcgctggatcaacaaccgccttgtggcaacatggctcaccctac

SEQ ID NO: 390044 - DNA, 415 bp, Homo sapiens
cctatgccccaggaggaaagccagggtcttctgtatcccagtgtgtgctgaatgatgttctatgatcactggccctgacacatttccctgactttgccttccaaggtcctcatatgcccaggactgccaaggctcctgagctaatcatgaaaatggcaagaattagatcagaagacacaaactgcctcccatacacagacttaggaattaaattgtgctgtcaatcagaccctgcaagggacaagcagtagaggtccctcaggccttccaatggcaacttttccagttactgtgttgaaacatttttttccataatctttgtggacatgctgaccaataactttgactccttgtaggactagaaccctagccaaagacccatctaagcccctctctcagggtcttgctgccatcc

SEQ ID NO: 390045 - DNA, 303 bp, Homo sapiens
aataggaagtatggtttattcccccatgctaatctggctagattaccctctggactattggtcacatcctgaccataccgtgttagtttttacaaaaaatagcatttacagctcaacctgcattacaaggaaaaaatgactatcaagacttcacaatagtggtcttcaaaacattacaaatttccaaatgtcaaaaatcgtgagacatctccaaaccacatcaacagttaacagaaagtcatatttgtcccttgaaactgcctctacaaaattataaaagaggaaattatgtcagtggaagaa

SEQ ID NO: 390046 - DNA, 228 bp, Homo sapiens
tctccctttcccattgcaatttgcttattatatcatttgcttattatatctgcattgctagttatatgggattcaaaagtattgtgtgtgccttttcttctcccctcacacgtttcccgcacagaacacttagtagtgcttatcactgttgaattcttacatttattgaattaattattaaaagtgtatccataatctgtttccctccctgagcttcctagaggaggc

SEQ ID NO: 390047 - DNA, 295 bp, Homo sapiens
atggccaagaccaggttttagtgccaaaacaggttatggaagggagaaatgaagagacttggctagaaggcgtggtcttgtctagaggaatcctcacagacagcagctttcagggagaatagaagtgtgtgtgcgtgtgtgtgtgtgtgtgtgttttccggacttttaaaagtgtccaactctcagttaatctttctaaatccagacaagggaaggcttcattaatgaaggtctctccagatgcaaattttcctcactaaagacagctttgcagggacacttctgtttgctgacc

SEQ ID NO: 390048 - DNA, 1917 bp, Homo sapiens
  misc_feature (1)..(1): n is a, c, g, or t
  misc_feature (3)..(3): n is a, c, g, or t
  misc_feature (7)..(8): n is a, c, g, or t
  misc_feature (1461)..(1461): n is a, c, g, or t
ngnacgnngagccagcaaaccagctcccactgcccctcccctgcccgctgagagtggcggctagcagggtgggggggcaggaactgaggggtgcggatccgggccccccagcctgcgaagcgcactcgcaggtcgagcgggcgtcgtccacccttcggagccccgctttcatgcgtgaaattcccagaagtcgcctgcgaccgcctccctgcttcaaacaccagagagggcccggggtcctggccggagacaggccgaacctccggagctgcttctgcacccggtacattgatcgatctgatgggctgcgcgcccggaagagctggagagatgaagccagcgtccagcttctcccccaaaccacagcacgccgagctttgtccccggggagcgtgaagtcaccagctccgggaggcgacaatatgagggcgatggacggggcagggacccccggaagccccagcaatcctcagggaagtgggggtgccggaggagtcggggacaccctcaggcctctccaagcccggagcatccccagcgcccgcagccctgtgagacgccgggtgctctggtaatgggccctgccgccaggcctcggcgctttgtccccggcccgcccggggatgctaccacgctagagttgtacaccaaggtttgtcttcccaggaagcgctggcggctgcctttgggccgcctggcgcggagccccaggctgcaggcgccgcgtgtgcgggcgggaagttcccacagttgcaaagaggcagcgaagtatgtgttccaaactttccacggttccaaactgagcgcttccattaagagaagcggtgtgcgggggaaaagcattctgggtattagcatgcaaatgaacgggcccggcttccaactccgctcgggattcccaccgctgcgcgccgagctcgcgcccagccacgcgcgccctgaggcttccgggcgttgccctggcggatgatccgagttcaaaatcgagacctctgccttctggtttcgtgtcctggtgcttagtcacttggcctccctgagattcagttaaactgtttcttaacctgtgcacagggacagcagcacctgtcctgcacacctccgctctagggcatagtacatgccaaactcctgttggagagaatgaattagaggcatgaagaaagttccctggacacgaagccaggagatctgtgttctaagcccagactcactgtcaccttaggctagtgcctccctctctgagccacagctttcttgggcggattttgggaactggcacgttttatttttgagagagctgctgggaacatccacaaagaaagagaaaggggccgggcgcggtggctcacgcctgttatcccagcactttgggaggctgaggcgggcggatcacctgaggtcgggagttcgagaccagtctgaccaacacggagaaaccccatctctactaaaaatacnaaactaggccgggcgcagtggctcatgcctgtaatcccagcactttgggaggtcgaggcaggcggatcacctgaggtcgggagttctagaccagcctgaccaacatggagaaaccccgtctctactaaaaatacaaaattagccgggcgtggtggcacatgcctgtaatctcagctactagagaggctgaggcaggagaatcgcttgaacctgggaggcggaggttgccgtgagccgagatcgtgccattgcactacagcctgggcaacaagagcgaaactccgtctcaaaaaaaaaaaaaatacaaaattagccgggcgtggtggcacatgcctataatccgagctactggggaggctgaggcaggagaatcacttgaacccgggaggcggagttgcggtgagccgagatcgcgccattgcactctagcctgggcaacaagagcaaaactgtttc

SEQ ID NO: 390049 - DNA, 1443 bp, Homo sapiens
tacagacgtaagccaccatgcccagcctggatattttatttagttggaattatacaatactgtatgtgaccttttgagtctggcttgtttcacttaacgtaatgttttcaaggttcattcatgttgtagcatgtataaatactttgttcctttttatgactggctgaatgatacaccattgtatggatatactacctttatccattcatccattggtggccttttggttattatggatagtgcaactatgaacatttgtgcacaagtatgtatttgagtgcctatcttcagttctcttgggtgtatacctaggagtggaattgctgggtcatatgatggttctatgtataacttactgaggaaccaccaaactcttccacagtgactgtaccattttgcattcctaccacacatgtttttataaataattttagtgctggtcaaacctctcattttatgaatgagcatgctgaggcccagagaggttaagtaacttgcccagggtcacacccttagtcaggatccagactaaaaccaaactttcctgagttcctagactttcaaacactaagagcctcccatgtcacctttaaagacctcgactacttgcccgagttttcattaattgacttagaaacctgcctggtgaacaactgagttagccgtatttatgaagctttttttctctcaacatctattgaaagaacccaccgccatgttccggatttctaggccacaccttgaaaacatgcagagctcacaatccctgcatctgcctcctgctgctggcctgtcgggccctcttctgttgccatggaaaccatgcacctcagttttggcagcagaccagctggacagcgaactgagaatatccttgtctcctaggctaagcagagctgtcaaggtcatgtattcattaactagatttgtatttattgatcacctactaagcaccaggcttttgttttgtaagatgctagggatacagcagtgaacaagccagaccacagatcctgccctcaaggaacccgtagtctagaggagacagacaaaaaccaaggaacaaaaaaggctttacctggctcctctccctagttcacattctcccaaccttccaggctgtgctaaaatccacttcccctggaccatccccggaagagcccaaatgcaggtgatagctcctctcaggatttacattgcattttttgttgttactccctgattgtaaaagtgctatgtgcattgtggaaaatgtaggagatacacaaaagcacaaagaagaaaaattaaataaagatctgtaatttcaccaccaagaatgccttctgagatctgccgagggcctcactcaggtgcggagcaagtggttctgtctcggccatgggatacctgtgtctgacctttttttgtgccggggtaaatgccggtccctatgggcttcaa

SEQ ID NO: 390050 - DNA, 1678 bp, Homo sapiens
  misc_feature (1)..(1): n is a, c, g, or t
  misc_feature (3)..(3): n is a, c, g, or t
  misc_feature (7)..(8): n is a, c, g, or t
ngnacgnngagccagcaaaccagctcccactgcccctcccctgcccgctgagagtggcggctagcagggtgggggggcaggaactgaggggtgcggatccgggccccccagcctgcgaagcgcactcgcaggtcgagcgggcgtcgtccacccttcggagccccgctttcatgcgtgaaattcccagaagtcgcctgcgaccgcctccctgcttcaaacaccagagagggcccggggtcctggccggagacaggccgaacctccggagctgcttctgcacccggtacattgatcgatctgatgggctgcgcgcccggaagagctggagagatgaagccagcgtccagcttctcccccaaaccacagcacgccgagctttgtccccggggagcgtgaagtcaccagctccgggaggcgacaatatgagggcgatggacggggcagggacccccggaagccccagcaatcctcagggaagtgggggtgccggaggagtcggggacaccctcaggcctctccaagcccggagcatccccagcgcccgcagccctgtgagacgccgggtgctctggtaatgggccctgccgccaggcctcggcgctttgtccccggcccgcccggggatgctaccacgctagagttgtacaccaaggtttgtcttcccaggaagcgctggcggctgcctttgggccgcctggcgcggagccccaggctgcaggcgccgcgtgtgcgggcgggaagttcccacagttgcaaagaggcagcgaagtatgtgttccaaactttccacggttccaaactgagcgcttccattaagagaagcggtgtgcgggggaaaagcattctgggtattagcatgcaaatgaacgggcccggcttccaactccgctcgggattcccaccgctgcgcgccgagctcgcgcccagccacgcgcgccctgaggcttccgggcgttgccctggcggatgatccgagttcaaaatcgagacctctgccttctggtttcgtgtcctggtgcttagtcacttggcctccctgagattcagttaaactgtttcttaacctgtgcacagggacagcagcacctgtcctgcacacctccgctctagggcatagtacatgccaaactcctgttggagagaatgaattagaggcatgaagaaagttccctggacacgaagccaggagatctgtgttctaagcccagactcactgtcaccttaggctagtgcctccctctctgagccacagctttcttgggcggattttgggaactggcacgttttatttttgagagagctgctgggaacatccacaaagaaagagaaaggggccgggcgcggtggctcacgcctgttatcccagcactttgggaggctgaggcggcggaagagcccaaatgcaggtgatagctcctctcaggatttacattgcattttttgttgttactccctgattgtaaaagtgctatgtgcattgtggaaaatgtaggagatacacaaaagcacaaagaagaaaaattaaataaagatctgtaatttcaccaccaagaatgccttctgagatctgccgagggcctcactcaggtgcggagcaagtggttctgtctcggccatgggatacctgtgtctgacctttttttgtgccggggtaaatgccggtccctatgggcttcaa

SEQ ID NO: 390051 - DNA, 477 bp, Homo sapiens
tttaaccatttttaagtgtacagtgtaaggcactgaaaccgcctttgcaaaagtataactgaggaaattatgacagtgaaagaaatcagacctaactgactctatcttgcttctaacccttaagctgtccttgttcgttcctgggtgtaggcggaactaactttgggaaggaattccgttcatgatttgactctgaaacaaagttgctaacagccctttcctgaaaaagactcccttcttgcctggggtccagtctgcctttgcaggactaacaaattagctacaagattagaaattacagtttaggggtcttgctgcttccggatccaagagtctgaacctctccaaatttgctcctgtggataacatcactattgtaaaacctaagagcagtgcttgagatattttgcagaccctgcactcgatggatcagctgacaccacctggaccagtaacctggcccaaccagttctgcca

SEQ ID NO: 390052 - DNA, 463 bp, Homo sapiens
gcgatgaacacacagtacgtgtgtctttttggtagaatgacttactttcccttgggtagatacccagtaatgggattgctggctcaaatgttaattcaattcttaggaagacatggtgcatctataccatggaatactatgcacccattaaaaagaatgaaatcatgtcctttgcagcaatatagatgcaagaggaggccattctcctatgtgaattaacacagaaccaggaaactaaatatcagacgttctcacttcttactgggaggtaaacatcaagtacagatggacataaagatgggaacaataaacactgagcaattcaatggggcaaggaagggatggggcaagggttggaaaactattgagtgctgtgctgactacctgggtgacgggatccttgtgctccaaacctcaacatcacacaatatacccagggaacaaacctgcacatgtacccccg

SEQ ID NO: 390053 - DNA, 798 bp, Homo sapiens
caggtgcatgttttaacttccccggagaccaaggatctggctggtttgtctcccccaacttctcccttaccccatgatcttcaggagatcacctcatgatcttcggtagcttattctagtattttggccaactaattgtcagaaagttcctccttaagtttaatctgtgtttcttctattttaatttaaacattatttggatttattttagctggtaaataaatatctgtctgagatttcttagcccgacataacaaagtacaatagacttggtggcttaaacaacagaaatttaccttctcacagttctggaagccggactttcaagatcagagcaccagtagggttggtttctggtgagtgctgacacagccttttctctgtgcaagcaggcggagagcaggagatcaagctttctggtgtctctcttcacatgggcccgctaattctgccagagcagagctgtacccccatggcctcatctaactctaattaccctctaaaggaccatctttaaatatcatcacattgggagttagggctttaacacataaatttacatttagtccataacatcatcctatctctgtatttctttcctttaggtttaataaatcagaaattctaaatatttcagaagacttactttatattctttgaaaaaaattaattaatgactttctcttagtcctgtgtatttctttcacctttttaaacatgtgatgctgcacaactatatttaacacatatatacacaaacacatatgcgtgtgtactgtctagctagcacccaagaaa

SEQ ID NO: 390054 - DNA, 391 bp, Homo sapiens
cctcaccaagtgcccagatgcactctgggtgttgagcagcaccatcactttccttgttcaggacccagtgctggacacaatgcttcttagtgtgtcctatcattgcatttgtcaggtatttactgagcatttaccaagatgctgtgagggtgtgtggggataaagaaattaatcagtcaagattctacctttcatgtgctcatattcttggtgaagaatagaaagggaaatatgggacaaagaaatagaaagcatgtatccacagcattaattcatgacagaaaatatggcaagataggtaaaaatgccttgctgtgggaggaagaaattacgaaggaggacagggaaggcttagtgaagtatatgaactaggctttgtgaagagtgaaga

SEQ ID NO: 390055 - DNA, 430 bp, Homo sapiens
ctcagcccctccctgcttactccctccttcacgggctccatgtcaccatctgtggcacagtccctctctgtcactctccctgccaccccctcattctccttcctccctcctgcctctctctgcatctctccctctcacccgtgtctcctctcctctctttccttctcgtcttctccctgtcacgcatctctcatcactccccctcattctgcctttcctcctactcacggtctcctctccctctccctctctctctctccccctccctctttctctctctctctctttctccacctcctcccgaccccctttcccctctatttctattggcttctgtgtcccttgctcccctcttctcttcctcaccctgggaagcttctcccccctatccttgcccctgcccccccaggatgtgtcctggagatggggg

SEQ ID NO: 390056 - DNA, 398 bp, Homo sapiens
tgggtgtgctgggttctcctgggtgtgctgggtctttcctgggtgtgctgggttctcctgggtatgctgagttctcttgggtgtgctgggtcctccctggtgggctgggttccctcaggtgtgctgggtccttcctggtatgctgggtcctcctgtgtgtgctgggtcctccctggtgggctgtgttccctcaggtgtgctgggtcctccctggtatgctgggtcctcctgcgtgtgctgcgtccttcctgtgtgtgctgggttcccccaggtttgctgggtcctcccaggtgtgctgggtccccccgccaggtaacccctagtcctcctggggcatgctaggatcatttctcacaccagacacaaaaagcctcccccagggtggcctcctggctgag

SEQ ID NO: 390057 - DNA, 335 bp, Homo sapiens
acctgcgcaggtcaggccacagttttctaccagccctctgtgggctatggttacaatcgttttcacgctgtttttgcaatgctatttggatgtatcctgcctatggccctaccagtagtttgtgagttcagtctttgatgtgctgattaggaccaggtccatgtgcatgcagcttgaggggatcatcctaggagtttgtaaacagttttatgggttagcttttctgagctcctttctcttcttagtgtctctggttctttccagttccctggggctccaaaagggagaaaatacggtaaactcgccaccattttggtgatagtttaaattttggt

SEQ ID NO: 390058 - DNA, 172 bp, Homo sapiens
ttttttaatcaaaacctaacttggtccgacctaccccatggctgaccacccaggcacttgcttttgacttaagggtagcaccatacgatgtcttctttttgtttttcattttaacaacctgtatttttcacatcacaaaacctttctagatattcactgtagaaaattcaga

SEQ ID NO: 390059 - DNA, 731 bp, Homo sapiens
cggatgcagagtgtccgcatgtaagtatacaaggtctctggatgcaaagtgtctttcgtcccaaagtattccagctggtctttcttattaggaagaaactactagactaacagtttgcgaacttgtttcctctccagacccgactaagactgtgtctggttggtcgcagttacttgaccttttaatgctgaatccttttttctgaggaatcaggctagcagtaccttccttgcctacttcacagcgttatcagagcaagtcagataatacgggttaaagtgcttgattattcaaatgggatatttcaaaaatagtggctttcttgttttcaggttgtgagcatggggaaaaaaaaccggaaacaaaacaggaacggaatcagcagcaacattaaggcagtgagccattttacaggaagaatgagcacagggcaggaataaatgctatttttacttttgatttgtggctatcacagtgtattaaaggttcttaacaaactgctgttttctccgcttacgttactaggaaatgtagagatggaacagtaaagcccagggtgcagttcttatctaatatttgtaaccctgtgaagtaggtgctgttatatattttatatgtgagggaacatgattttagaggttaagttacttgcacaggatcacatggataagtatgcattgtgaatttggttgtgactgaggacattttaagcaaattaacatcttgtgctt

SEQ ID NO: 390060 - DNA, 385 bp, Homo sapiens
gtagctggatttacaggcacgcaccaccatgcccagctaatttttgtatttttagtagagatgagatttcaccatgttggccaggctggtcttgaactcctgaccttgtgatccgcccgccttggcctttcttatattttttcttgctattggaatgtgacagtttctacctgcagttgtcttggtgatgttctgagtcgcatttctccttttgacattgttttcccatttcctaattgtaaacacctctattatcagtatatttgggacatcaattaatgtcaggatacacagatctcatttaaaagtagtgtagtattccactgtacttattcacacagtagcttgttggtggcacagtgtagcattcctcgaactttttttc

SEQ ID NO: 390061 - DNA, 458 bp, Homo sapiens
taggcttttgtggattacatacttcattgacagtgactggttcagaaatgagtatgtaatccaacaaaagccaaagagaggccaggtgcggtggctcaggcctgtaatcccagcactttgggaggtcaaggtgggcaaactgcttgagcccaggagtttgagactagcctgggcaacaaagtgagaccccatctccacaaaaaaataaaaaaaatagccaggtgtggtgacagagcaagactgtctcaaaaaaaaaaaaaaaaaaaaaaccccagagaccaataggggggggcgggccagaaccctgggggggttacgaaccctttaaatggggtttggcccaacggggaaattatccaaggcttgaggatccttggggattgggcaaactcgttttgaaaaaaaggtatatagatcataaaaatttttaatggggaaccttgtggcccaaggtcaag

SEQ ID NO: 390062 - DNA, 248 bp, Homo sapiens
tgttacttgagactgtctgtccttccttcttcagtgcctctttctttaatacgatgttaaaaccaggtactgtgattgctcacctgagttttggttcttaagaaggtacttttttgtgtgtggatagttgttcaatatggtgttcgtgcatggagaatgattgcttgaggcttctatttagccatcttgctccacttcctctcaccaggtgtttttcattatgaagggaatattggattttgccaaat

SEQ ID NO: 390063 - DNA, 239 bp, Homo sapiens
tggagctgaaaagtaaaataattgaacgaaaaattcactagaggaactcaagagcagatttgaactggcagaagaaaatagtcacagaaaatacagcaaggtctttctgatccagtctgagaaacaaaatgaaggtgaaaaaggagaataacaaggagaagaagaaagagggggaagaggaaaaatgaccaggaaacaataagaaattaataaggacataatattaaggacataataag

SEQ ID NO: 390064 - DNA, 544 bp, Homo sapiens
ctggacatgggcagtttctccagcacatccacacatgcacatacagtacacacacagggtgggtggagcaggtaagtggaaccactccacctgacttgcacccccacgggctgtcagcacttggcaggacatcccagtcctcagataccagaggtttgagggtaagaactgaacacactggggctgggactagcccagcaatgggactgagggcctgggtggcgggggcaggtgaagggggcaaggcttaagtccagaaggcagtgacagctcccaaaccaacagaccctagagcaggaagccccagggtcagggatgggacaagcaagatgggtaagctctctagtggctgctgggagccttgagtcctagagcctcctgtcccgttccccttttcttgctttcctggtatagccccaagctcggcccacttttccctctcccctgaagcctgcctaaacaccactaccccttggggaacctttaccctagaatgtcatcttaccaaagctccctcctcaccacccacgcctggcacccaagc

SEQ ID NO: 390065 - DNA, 505 bp, Homo sapiens
gccagaaagggtcaaggcagcagacaggcatcaggggttagctgtgaccttttgttcctattattagatcctcagcagccatctgtcccattagcctccagcttgtggtggtgcttgggcctcaccaactcctggtacctggccagggctagggtgtggtcaggctgttgcccaggagcccagttaccaacctcagggtagggctgccacctcccagcctagaaggccatgagtcacccttccaccagcagctgagggtccccagcgagtttctaaaattaggaggcccagtccaggccttgctctctctcccagggctgaggcccagctcacgcagccgcccctccagagaggagtggatggggcccatggcttaggtaatgccccagaaaggaaggccctgcagtgcagatgctcaggcggcctccttaccccctgggtctcctgctgcttagcagccccaaagccctgtcttcccccagcccagcccccacccccacacaag

SEQ ID NO: 390066 - DNA, 175 bp, Homo sapiens
attcaggataatttctgattctgcctctcttcccctttccccatagtgttcattttaatgtttctgccattcatttgttcattcagtatttattgggaagacttgtcaagcaccatgataagtggtggaaaataatgattctgacacttgaatggtgttttacaatgtacagatc

SEQ ID NO: 390067 - DNA, 253 bp, Homo sapiens
tcccactgcttcaacgagggtgatgaattttcctggcctcggtctcttgcttggcatattgggaatgacctgagaaggtctggatgccacagaatccttcatgcctccattctgacacttcccccacaaaacaattcagcacatgaaatcaggtccacactggtttgccccgcgtcccaagatgatattccgtggtggtgacgctgccatgcctgtcactcccacctgcccacatccctgtgctgtttcctag

SEQ ID NO: 390068 - DNA, 1842 bp, Homo sapiens
ttttgtatttgaatgcgcatgtgtgtgtccttttaaaactctttccatttgtacaatgacagatttcagattggagttaatctgagcatggaagactatgccctgacgtttggaattaatcccttcattgccttgatgattcaacccatcgtgacgatgactgtggttgacaaccaaggactggggcttcctgttgacattcagcacaaagcaaagccctcgccaaaagccagccagatgctgccacctgatcttggacctcccagcttccagaacttattaagtccatctgagaaactagagccttgggacccagggatgaggaaacttaccgtacagacatgcgggctgaccttcattcaccctgcgggccatggcctctgccatccaactgcacaggcttcagccgaaactctctccagcactgccctaaacagaccaagtgtgagggagggagcatgtaatgaaaagtccacagagaacaagaagccacaagattcggtgctctgaagccattctagatggtttcaggggaactagcttcccacctctgacagggataccatggcaaataccactctttgcctaggattataattctttgtgcacaatgcatcccatcccaaagacagtccacagcaggacttgctccatctctgaactggtcttacccccttaaacctgcctttatatctaggagtttctttattttattttatttttttgagacagagtctcgctccattgcccaggctggactgcagcagcgtgatctcagctcactgcaacctccacctcctgggttcaagtgattcttgtgcctcagcctcccaagtagctgggattaaaggcacgtgccaccatgactggccaatttttatatttttagtagagatgaggtttcaccatgttggccaggctggtctcaaactcttgacttcaagtgatccacccgcctcagcctcccaaagtgctgggattacaggtgtgagccaccaggcccagcctatatctaggagtctcttgatgagcattggtcgacagaaagaagtctcttctaaaaattgttaatgcttttatagactactcatagtctgcgtcataaaacatcatttgcctttcaatttataccttccaagtgaatatgattattgaggattatctaattattatctacttttctctctaggtataaaaaacaccatagatcctatacacacaaaaatggtctttctatcagaaatggactcactcgcctggcaaaaggacacagattagattattctaatctcaaggccccttaggcttatgaattcaaaaaaaaaatagaagaaatgaacaaaaacataaatcacagtttgttattaagtaatatctgaaatgaattagaaagaaaccataagccttaacaatactccaatcacagttaaattaatttagacagaaaagcaaatagcaattgacttgaaaataagaagtggggccgaaggtggatacaagaaatccaggagggctaagatatatcccaaatccaatgttcatcaatgcctacacattcagtacaacctgatggcattaattctgtggttggggaaatgtgaaagtgaaatcgataataccacagttctaaatgtgcactgttggctgaacttatggtgtggtggggggtggtaaaaattaggcttctaagaaaggatgggactctgccctccaggcaaggagtaaatggccccagcagatggaaaactaaagcaaatgtaatcacctgcattttgaaaataggtgtgtttctgagaatttgtttgaattagttctttgtaaataaaacaggattttgaatgc

SEQ ID NO: 390069 - DNA, 1131 bp, Homo sapiens
attttacagatggcttttggcttgcccaaggtcaccaccctctgaactgaggcgtccccaacccatgccgggagctggtggaggaagtggggaagggtttcccgcttctccactgggggtggaggtgggagaaagcattttcagggtgttttgacatttaacaaacagtatgcaaatcacatgcaaatcgcatgcaaatcaccacccatttcttaagcctcgacagcgctggcatgttctgaaataataatgttggacctgtcccttgatgatgacctgggtcgggaggtgcacggccttttccttcctccgtcttcccttcccttcccttcccttcccatctgttctcccttccttcgcccccttcctttcctctccctccctatcttccatttttctcttcttccttcacatcatttgtccaagacctccctggcctgagataaacataagttgcaaaagtggcttcctgcagcccattttccaggttgggaaactgaggcatgggcctaaggtcccacagccacaccgaggaaagcagcccccactgaatgtcaccatgcaccaaagtgcatgttcctcgtgacacaaagaggggagatgacagtggctggagttgtcagagctgctttgaggaagctccaggcctgataggcttgacagggccaaggggaactattgtggaatgtcttggccttgaatgacaggctgctgattttggatctggagaaagctcacactgactcttcctgctcccccagtctgtttttctcctgctactccatccatgtatccctgagtttgggccacagtccctccacttggtttgcatgtcccaccttctttgtttggcaagctcctattcatccttcaaagccctagcttcaatacctgctacttcatgcagccattgcttatccttcaaggagagcctacttccctcaaggaccctgctgcttccagtctcaccttctgactcactcgggatccactgaactgggaggtctgtgtctcctcccagcagagtcatcactacctttggggccgcaggatcacccagcttggaactagatacagaaatgctgttttgagagtgtactgaataaaagattacatgtttgaaaacaaaaa

SEQ ID NO: 390070 - DNA, 448 bp, Homo sapiens
atatttataccctttgattcagaaatgctacttatcctcaaaacatccttccccctgggggaaaaaaactcaagagtaatgtttactatatcactgttcataatagccgagtggtaacaaccaaaatgtctagcagtgaaataatagtggctaagcaaattaggtgtagaagccaggcaaaatggctggcacctgtaattccaccactttgtgaggctgaggcgggtggatcacttaaggtcaggagttcgagaccagcctggccaacgtagtgaaacgttgtctctactgcaaatacaaaaattagcttggcgtggtggtgtgtgcctgtaatcccagctacttgggaggctgaggcaggagaatcgcttgaacctgggaggtagaggttgcagtgagtcaagattgtaccagtgcactccagcccaggtaacagagcaagatgcca

SEQ ID NO: 390071 - DNA, 292 bp, Homo sapiens
ccacttttaaagtgctttgcatggttctcaatatggctctttgtgttttggttgtatgttttatcttttaaaatttttatttaggagggattcctacataactagattagcagtgagagtagtggtctcagaaatcacgcgtggatttaggattcaggatggctatattaattcagaagtaaaaatacacatatgacagagacaagagtttcatgagtcagaaaaagaaaattccaggtaagcctggctttatagctgtctaagtggtgtgctttgaggtgagtcaacacta

SEQ ID NO: 390072 - DNA, 311 bp, Homo sapiens
ttcagaatattttcccaaaacttaaagatccatttttatttaagattgaaattttctaaccaaaacaaaacaaaaaaatcagcagcttgacttggggtgaatcctgaagcattttctggaactcagtaaagacagggatatattctattaactttgaagaattcttttcttgcttttgaattttgtccttgcttacatctttatgagggtaagaaatgtgcatattataacaaacaatgaatagaaaaacaaagtgaataaacaccactcataaacagtttgaattttggcccaaatacagaatcttgatc

SEQ ID NO: 390073 - DNA, 498 bp, Homo sapiens
ttctctttaagctgtagctgtggtttctgcagcaattttgtttttgccttgaaagaggtgctctggattatcacacctccatgtatgacaatttgtacctgcatggaattgaagactcggaggctgtaagtattttcatagatagctaattccctctcccctcctcttcctcctcccactatcccctccacccccccgcttcttatttcttaggcaacgcagggaacatggagcagaaagctaacatcattctggggcttgctggctgctgtgtaaatgttctctgtgtagtttataggtaactaaaattatttattgtcaagcaaaaaagaaattagggtgatggcaaagcattcaagagtgtaggctgtttgaatttatacattaccgggtccacgtttgatctcaccaggggtaactgctccttgcagactggtttaaactatgcagaaagtgcctatgttttccaatagcagggttcatagaaaagcctcattc

SEQ ID NO: 390074 - DNA, 1353 bp, Homo sapiens
gcactccggccgggctctgctggctgcggcgggagctggacgcgggaggaggcggcggcggcgctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttctctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgc

SEQ ID NO: 390075 - DNA, 582 bp, Homo sapiens
tgttaagatattggtatttctgagaggaggggagatttggacattactgtttaatggggatattgtttcagttttggaagatgaaacgtttggaagatggatgctggtgatggttgcacaacactgtaattgtacttcatgccactagactgtgcactaaaacatgcttaagctgaaacattttatgttagcatatatgtaaacacacacacaacagaggaaataccatgtttgaggtcagatggtgggtaaatggtagaaattgtcaaatgacaatttgtctatatctttaaaaacaatttcagagaattttttttgtgtgtgtgtgactgagttttgctcttgttgtccaggctggagtgcaatggcgcgatctcggcttactgcagcctccgcctcctgggttcaagtgattctcctgcctcagcctcctgagtagctgggattacaggcgcatgccaccatgcccggctaattttgtatttttagtagagatgggctttctccatgttggtcgggctggtctccaactcccaacctcagatgattcacccgccttggccacccaaagtgctgggatta

SEQ ID NO: 390076 - DNA, 399 bp, Homo sapiens
  misc_feature (7)..(7): n is a, c, g, or t
  misc_feature (17)..(17): n is a, c, g, or t
  misc_feature (37)..(37): n is a, c, g, or t
cgctctngaactagtgnatccccccgggctgccaggnattcggcacgagagtatgttaacaataattatttataacaatattttgtattggatagcacattccatctgaatatttcaaattggcatggtcccttctaactggcattaattcattcatcttgcatccccaagtaataaagttattcccatttttaaatggagaaatcaagattcatgcatttcagtgacagatgttcaaattcagaagaaaatctctgtttgagtttgtctttgccttgtaatacgtatttgtcactaggcctccattattaaataagaaattgaaccttgcatttagtcctatgatctttacccacccaagcacggaggtaacaaggtaactgtgatttaaaaaaaaaa

SEQ ID NO: 390077 - DNA, 672 bp, Homo sapiens
ttgttgagacggagtctcgttctgtcacccaggctgaagtgcaatggcgtgatcttggctcactgcaacctccgcctcccgagttcaagcgattgtcctgcctcagcctcccaagtagctgggattacaggcatgcaccaccacacctggctaatttttgtattttttagtagagacaagctttcaccatgttggccaggctgatcttaaactcctgacctcaagtgatgcacctgcctcagcctcccagagtgctgggattacagacatgagctactacacccggcctaaaccttgcatttttaagagtggaaactttctctttgtgtaggggacagggtaagaggaagataaatgagttcttcctccttttaattctctttgatctcctggtgatgctgaaaaaagaaaaacgaattaggtactcttctgcctgaaaaaagaagaggttttctagacaagcaagacctttaaaaagtatcagaattctttatgcctttacacccaaaagataattaacatatagatttgactcacattagcctatgaaactgcaaacattttcatggcctcagcattctcatatttctaggtaaggatatactttcagaagtactccatggtagcacttagccctattgtgatcatttacttttctgtctgccttctttt

SEQ ID NO: 390078 - DNA, 259 bp, Homo sapiens
ctgcctcagcctcccaagtagctgggactacaggtgcccgccaccacacctggctaatttttgtatttttagtagagacgaggtttcactatgttggccaggctggtcttgaatttctgaccttgtgatccgcctgcctcggcctcccaaagtgttggggattacaggcgtgagctaccacgcccggccaacttgcttttctctaatggctggcgatgttaattttttcactggcttatttaccgtctccttctgtgga

SEQ ID NO: 390079 - DNA, 330 bp, Homo sapiens
agggccatgagggtgcacagcctggttgcactcacttggcaccaacagaggttggctgatatgacactcaagatgggcctggagtctaaggggccctgggggtgtgagagagcctatgggttaggagatctgtgcatggaaccaccagccttctgaggagccctgagccacagctccttcccacccgcccaggcctcccaagaggcttgagtctgtcccttctgcgagctgcttgcctctcttggtcaccctaagagcaccaaccgagtcaggctgggtttagagaagccacttggccggtgccagggctgggaactgggaaggttggta

SEQ ID NO: 390080 - DNA, 223 bp, Homo sapiens
cttgtcccagagtaagacctatggaagtgtgcactaccttgtcacctaggagaccataaccctgtgagggcaggaatgatgtgtcttgctcctgctctatcccaggtgcacagagcacaaccttcagtatttgttacaggaccatattctgttcctactctgtgccagacactgtcttaagtgctgaagatgcatcagtcaactaacagaccagcatccccct

SEQ ID NO: 390081 - DNA, 478 bp, Homo sapiens
aatcctggaggatgctccttacagattaaaaaaaaaaaccttttgaaaaaaaacaacaacagaaaggcaaaaacaggtacaggcactgtgatatgcaagggagtttgtaacacttaaaaaatatatgtgctgggattacaggcgttagccaccgtgccctgccggtaggaataaattataactcaaaatatgaccattaagtgtaaggtagccccgacaggcatcactccactaaacacagtaaaagaatggacattcatagggaattaatttatcaacaaagtaaataagtattaagaatattctaagaaagcaggaacatttttataaagcagttagaattttttaaagttgttttgttttcttgagacagagtctctgtctcccaggctggagtatagtggcaagatgatggctcactgcaacctcaaacccctgggctcaagtgatcctctcacctcagccttctgagtagctg

SEQ ID NO: 390082 - DNA, 464 bp, Homo sapiens
tcaggttttgtgcccagggaacaaggcacccaggggtgggggtggattgtagtaggaaggcaagagtttggatttagagatgtggcactggaggtgacaatgggccattcagatggggatgttcagtaggtagttgcagccatggtggtggcaagcaagggcacacacccagatttggaattcattggcacagaggtgggaaatgaatgcatgaaagcagataagctttcagagctgatgactgaacctgaactaggaaaggctgatcctaagtcttggagagcatccacactgagggagcaaggggaggaagaggtggcattagagggaaagtaggaagggcggtgagcgtggtgaaagaactaggaaaacaacacaggcaaaaagtagcaggagagaatcctcctcgaatgaccaaatctgcaaaatgaaacggagatgttaaaggaaatggtgaacgacat

SEQ ID NO: 390083 - DNA, 1212 bp, Homo sapiens
cgcgcagaccgagcagactgccgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggtttgttttaccatcagccattataaatgaaatatcttttactacaaaagtcccacaaaagtatgagaatgaaaatgtagaaacagtaaccaaacaggcaatcttaaatgggagtatcgttaagggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagta

SEQ ID NO: 390084 - DNA, 1294 bp, Homo sapiens
cgcgcagaccgagcagactgccgcagcgactcatcctatcgataaggttcagttagccaaggtggaggatgggaaaagaatggaactgtcccagctactcaatgagatcagggcaaactatgaaaagatcctcaccagaaatcagatagagacggtgctctcaacaaggatccaggtaatgatttcatacagacaggcaccttccagaataaggagacagtccatgtctacccaattcctgtcccggcctctctgagctagaagaagacataagcaaaaaaatggacaaagatgaagaggctttgaaggcagctcaagcagaactcaaggaggcccgacgccagtggcaccacctgcaagtggaaattgaatctctccatgctgtggaaaggggccttgaaaactccctacatgccagcgagcagcattaccagatgcagctgcaagacctagagactgtgattgaaggactagaaaaagagctacaggaagtaaggcgcggcatcgaaaagcagcttcaagagcacgagatgcttctcaacacgaagatgaggctggaacaagaaatagcaacttatcgccacctcctagaaaaagaagaaatcagatattatggttgtatccaaggtgggaaaaaagacaaaaagcctaccacaagtagagttggtttgttttaccatcagccattataaatgaaatatcttttactacaaaagtcccacaaaagtatgagaatgaaaatgtagaaacagtaaccaaacaggcaatcttaaatgggagtatcgttaagggagagcactgaagctcatggcactattcagacagagaaagtggatgaagttattaaagaatgggaaggttctttctttaaagataaccctcgattgaggaaaaagtctgtttctcttcgatttgatcttcatttagcagccactgatgaagggtgtttagagactaagcaggataatctaccagatatagaagtcaggcttatcatgagaagatcatgcagtattccctctatcaaacctccatcaacagctaattaatccaaagatagtatttgacttgattggaaaatgttaggatggaccaaggtgggccataccaactccctctgtcccaaaatgtaagttattacgtatgtatggaaaatgttatgatcaatatgtggttctcttcagaagaaaaaaacaataaaggacatttctctgaatctaattatggagatagacatatatatatatatatgaatgagagggagtagcttaaaaataaaatcacaaatccagta

SEQ ID NO: 390085 - DNA, 590 bp, Homo sapiens
gaataaatataaactgtacaaagggcataaagaccaaaatgaaaacccttctcatctccatatcccactctccagatgttctctttctcatttcattttttaaagtttgcctcccactcttttttcttcctttcattctaaaaatttctaaatatttctgtgaattagtcatgcagcaaaaacatacatcttaatgggctaggacatcaaagagtctataaaactatgttaacatttacagatttcatggtaaagggatatttatgttcagaacataatgtatatttaagaatttttaaaataagacctcatagcaaagcatgaacataagtaataattaataatgactataactacttagagtgagctagtaacttaaattctaggctgttggaagccattacataatctttggtgttatctttttatttaaaaaaatataagagctttttgacccttttaaaaaaattaacagtgtgcagcctggccaacatggcgaaaccctgtctactaaaaatacaaacattagctgggcatggtggtaggcacctgtaatcccagctatttgggagactgaagcaggagaatca

SEQ ID NO: 390086 - DNA, 476 bp, Homo sapiens
  misc_feature (2)..(2): n is a, c, g, or t
  misc_feature (41)..(41): n is a, c, g, or t
  misc_feature (49)..(49): n is a, c, g, or t
anctagaggatccccaaaagtgcactcttctatatctactncagaaagnaggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagatatagaagagtgcacttttgaaaagtgccctctttctaatatctaggtcaaccagaaaatcgtttctcccaataacttattgtgggttggatcctcagccaggaggcacaggcccctacaagatcccaggcttccaacacggacacctggaccctcccatttgactgcagccttg

SEQ ID NO: 390087 - DNA, 517 bp, Homo sapiens
  misc_feature (2)..(2): n is a, c, g, or t
  misc_feature (41)..(41): n is a, c, g, or t
  misc_feature (49)..(49): n is a, c, g, or t
anctagaggatccccaaaagtgcactcttctatatctactncagaaagnaggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagacgaagctacgagcgcactgga

SEQ ID NO: 390088 - DNA, 515 bp, Homo sapiens
tcctgctcgtcaaggacaggactgtgagcattcgtaaacagtgaccggaaaacacaccctcctcactgctcgagtttggaggctgccacgagacccactcaggattttcagacatgggcaaaccgaggaagagaatcaagcatgacactgcctttctcataagcgctgtttgtgagagtaacaagatagttgatcttggattccttcccgttatagaaatggtcctgctaacacatggagaggggctgatgggactcgaagagctctgtttttaaccctgatgagagaatctagtcagtgatcattttgagccttcgcaacacaaaaaagccacccagagagcaggggttcgccttaggccttgctgggaagtctaagctgcctctgaccaggcctctcggtgagcacccagctttcagaagaacgggggacagagccttgctcgtcagcaccagggtgtaatcagcaaagtgcagatgacccgatgtcttcagctaataaattatcggggtggg

SEQ ID NO: 390089 - DNA, 380 bp, Homo sapiens
ccagagggaaagaacttagtctaattttaataaaacaagtgtttatttagttattcagttaaaatggtcaacatttttgcactttgttacattttctcctacatatttcaaaatatacactaaattaacttttttaatatgttggatttatggattcttgcacatttccattgcagatcaaccacttaccggcaaaaatgtgccctccaattcttccacattgcctctttgtccaggtgtccagcagcatttcttccctatggtatctctctcacccctcccataagatctggatcctctctccttgtgacttcaggctttgcttcctccacttcacttacatcactgaccttacctctcagtgtggaattctctaatgc

SEQ ID NO: 390090 - DNA, 141 bp, Homo sapiens
gtaatttccactcactgtgaagcttcaggccaccgggtcctccccagttctctactccagggtggggaggccccatcgccagtcctcaccatgagcatccagagcctcttcactgtctccctgtgtcctgtggaagccaca

SEQ ID NO: 390091 - DNA, 527 bp, Homo sapiens
cagttattactaagtatatgatttaaaatccctaattagggttcttaaacaagggagaagcactctcatacccctagaacaagatgaacaaaagaaggaggaaaaatcttgacctccgtaagatccaggatggcacgtgcaaggcactgacacagcatctgccggcatcactgactctcctggaccccagaagcccagttccccaggctctgaaaccctgcagcaatgaaaaggaagcacaggcaaaccataaggaagataatttttctactaaaaaataaatagaaatgcatccttagaggcaggtttcatgaggacacagagaatccggttttgtgtgtgcctgatttcgtttttctgtcaaagagatacaaaacaatcaactgagttatcttgaacttacaaagattaaaaataatcaattcctgttactattttcaatttttcccccattttacttctttaggtatgaagaaatgtagcctattaaaacctggattaataaaaacctttcattaacttttaaa

SEQ ID NO: 390092 - DNA, 322 bp, Homo sapiens
gtggcatgcagtcctgaataaagctcctgtggatcaggcaagttcatttttgggtcactggcacttatgtatccaccattatcttggcccaatctcattatattatgccaactttgagggaagaactgagtcatcaccttcctttgtaatttcctagacaatgctccactcataatgggttttcagaaacatatctacctgatcaaagtcactcgcccactcattcaccacaaacctctgatgatgagatttgttttattccttgtgattcatcttggtgaatgtaccatgcggttttgaaataaatgtgttataatgcaga

SEQ ID NO: 390093 - DNA, 205 bp, Homo sapiens
tggaaaccactgatgtagtcaacataaaccaacatttttacacttagctagatttctcccattgtgtataaacacacaggtgatgtttttaaaccagtattttaccattgcctcctattaaatttcatctccgtgaacgtagctatagttaaaacttgagatcttcttgaatcatgattctgtcatccaagggattagctttcct

SEQ ID NO: 390094 - DNA, 160 bp, Homo sapiens
gctcttaaatgttcatccacttttaattatttacaactaataaaacatgtaataacacggtcaaaattatcggagtaacttcctttcaaaaagcacatgtttgtacagtgattctttatataccttgaattcaacataatctacttttgcatctccctgg

SEQ ID NO: 390095 - DNA, 240 bp, Homo sapiens
catttttgttctcatagctgttttattcctcttctctgtatttcttactttacttttatttgtgtctctcaggtaccctgtgatttagttttcatttttagatgattttatcttttcagtatattgcctatgtttgttcaactctcattttacatcttactattgagtttaaaaatttttatttgctgtgttcttttatatgtgcaattaatgatattcatgttggagtgttgtatatta

SEQ ID NO: 390096 - DNA, 319 bp, Homo sapiens
ccctttcaagttcccaggccttctcctgctgggaaaggctttctcatgtctactcacatacctttgctgcatactaaacccatttccgcgtgtccgccggtcactctgccctgaatgataaccttcgataggtttacaaatgctcattaagtcacccttcaagtttatcttcccggagccgataatcacaatgccttcagcttcctccgtgttacaaaaagcaaagcgaagcaagacagctggggaagcagggaggcctcctttatctctggctccagctggactcaggaaaggctctcccaggttgtgcctccccaca

SEQ ID NO: 390097 - DNA, 419 bp, Homo sapiens
ttcctttaacatgaggttccaaattggtttcctttatgatcgacctcactaagtaatgaaaaatttcagtttctctaagtatgtttttctggactttatgccctattcttttgcatttctatctttttgtttgggtaagcttttcattctagttaaaaactagttctttcctaaacacagtcttcagaacaaaaaaccttaatcaaatagatatcctctaatatatcttaggtatatgaaaagtggctcattgtgacatccaattgctggtggagaagagccccaaaaaggaacgaagatatgaggccaaggtgggcagatcacctgaggtcaggagttcaagaccagcctggccaacatggtgaaattctgtctctattaaaaatacaaaaattaactgggcatgatggcacatgcct

SEQ ID NO: 390098 - DNA, 892 bp, Homo sapiens
gagcggccaggtggaggaggagcgcggaggcgaccgcagcatctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcac

SEQ ID NO: 390099 - DNA, 741 bp, Homo sapiens
gtttcaccatgttggccaagctgatcttgaactcctgacctcaagtgatccgtctgcttcagcctcccagatgctgggattacaggcgtgagccactgcacccgaccaatatttttactgcctcttttctatgtttagatacacaaatccttaccattgtgttaccattgcctccagcattcagtacagtcacacgctacacaggtttctggcctaggagcagcgggctagaccacacatagcctaggtgtatagtaggctttaccatctagggttgtgtaagtacactcttatgatgttcaaacaatgacaaaatcagctaacaatgcatttctcagaatgtatccttgttgtcatcaagtaatgcatgactgtactctaaaattggcagtgtttttgtttgaagcaatctggtaggaattttttcacttgtattcttgatgaatccaagctcttcacttgactagctgtgcctctttgggcaaaactacactttttaaaacttgcagtgcccttttctatcagaagtggataatacctatctgctggatttgttgttagggctgaatgaactaaaatgccctcacacggtggccagcagtaggtgctcagaaagtgttagcttttttttttttttttttttttttttttttccctgagatggagtcttgctctgttgcccaggctggagtgcagtggcctgatctcggctcactgcaacctccgcctcccaggttcaag

SEQ ID NO: 390100 - DNA, 889 bp, Homo sapiens
aagacctgcagactgcgtaagtgacagaagaaatgggcttccctacataacttcatatttgtgacagttaacaccagcagttttcaaatctgtcaaactaatataatggtttctaaattagtcatggtgatagactatattattgttactaagcctgtattccttcctgttgaggaatataaaatatacctcaccatcctattgatgtcagacatggccaacttgctttgcccaatgaaccatatatgtcttccaggtggaagtgtttggagccaaaattgtacttcttagctctcttttctatctcaaaaccagagatcttccatatagtggctgctccatcaacatgtattccagaagaaaggtgtaattcctaaaagattattccacatagacacatgtgggcacatgagtcaggctattcccatttctactcttagttaaattattatgcttgggagcttaaaaaattattcaacaattcatgcataaaaagcaaatcatctactaggggaaatggaaaagaatctggctggcttgcatgagacttctctactgaaacattactcagtgctataagactgaaattatgccaattgtatcaaaaactccagaatcaaggaggacattctaaaaggttactagagaatatagaacaataataagttataaaaaagtggttgaaaaactaagtatgaatgttacaaacatggacaatgtaaaaatagtaaaatgagtaaatattaggatgtgaggaggagaaaaatgagaaatgaaactgctaatgtcataccaaagcatggttaaatatatcccacctaaaactgaaacaagattgtaataacagtatctgtaattttttttcttttttttttttttagaatttgct

SEQ ID NO: 390101 - DNA, 707 bp, Homo sapiens
gtatgtgggccaaatacagcttttggagtggttgatcgtactagcgttaaaatgtcgccattggtgtaaataattcctctactttgttggctgtttcttttttttcttttaattttagttctgtttaggcatggagaagttgtaagtggttttcttttgttcatttatttggttagttttaagtttggattgtgaccccttcatccagagttttaaaattggaagtcagctctcttgagtcacataatcttggtatgaagtttaagatgaatgaaatgcaagcatacttgggaaaaaaaagaattttttttactggggacctatcgttcttttcttaccaaatgttaagagtatcccccaatatttttatagtaattataaaatcacaaatttattataaccccacagtaggtcctagagactaactggaacagaaagcaatattgttttaattgtttgatctttgagctctagtaaacttctctatcttttcttattttcttttaaaattacaaaataatgcgtacatattataaaacatttgaaagttacataagaaaatcaaaataatgtcactacttgagagaaaatcacgttagtacatacacttcctgtttgtttttaggcaatgctagttttttttttttattgaacataatgttctataatgtgatttcccctaaatatactgtgaatactttcctctg

SEQ ID NO: 390102 - DNA, 489 bp, Homo sapiens
ctagagttttctgtagattgagagaaatgaataggttgacttgtgtttctgtatgtctactgggtcaaaggaccattcttgagatgtgaaagtaccctaaagagtggcacagctggtaagtgttatgagttgtcctttaaaaaaaaaatggggttttgagataatagtaattttgctaatcattagcttattccattttatgcctatattgtgatttgattctctcttcccctcttcatttagtttttccgttttctttcaagcttcattcccatttgccccatgctaccagttctttcttctcctggaatatttgcctgctccaccatggacagactcttagttatccttcacaatccacctccagtcccacctcctctgtgaacctttcctactgcctcatttatccattcttctcactaatttgttttctcccttttgcatccacacatcctactgatagtatcaataaagctgatattccactga

SEQ ID NO: 390103 - DNA, 322 bp, Homo sapiens
aatattcaaataataacaaaagattacatttaaaaacaggaatgactcaggcgcgtactcctccctgaactccggagagtgaggcacactagccagcatggtccctgcagtgcccagttttgaatttagaattcatagcttgccgttttctccgtgaatggtaaatactttaatgttacgtggaatactatttgtacaacatttttgtctgttgtaagcctaaggtgggtctaaatttcatcatcgctagaaatacccttttcctatacagacagtcgggcttaggactgtccggctggcatgagagtgacacacattcagt

SEQ ID NO: 390104 - DNA, 608 bp, Homo sapiens
agagaggctgtccagcttgcccaaggtcacttaaggaaggcccatctggctctaatgcccagactcttccattccactaggctggctaaaaaggccctagaagtcctgccagcattttcactctgatattctttaactccttcacagcttttaatcctgccctgtaggaggaccaaacattactgtctcctctttcacagccccgctactagagcaagtaaatgacttagggattcctccatcacctgaaagcagcaaaagaagatggtacagcattcaattttctccttcctccataaagaaattcccgtcctttatagccagctctgcccaccccttcctcattccccttttcttagacaggcagatattttcttttctctttccctttggcttgtgattatcaggtaaatatccctggtttgagggaggagcagaattttgattaggttaaaaaattatctttacccatagcctttctatgacatagaaattccaggtaggagtaaaccatatatatatcggtatatctctatccatctatatatatatatacacacacacacatacatatacacacatattataatgatataattatatatgta

SEQ ID NO: 390105 - DNA, 367 bp, Homo sapiens
gctccctaaaataaatgaataaataagcagctgaagctgattctctcctgcttcatttcttctcttccccgtctgaaccgtctcacctgcactcacctttgcctcctttgatcccctcctcccactcttgctcttctagcttaatctcagaaacagcgaatatctggcagaggaaagcccaccttagtttatcagccatcatcaaaagtaaaccttaaagacataagagatttcctggctaggcacagtggctcacacctataatcccagcattttgggaggctgaggcaggaggatcacttgagcccaggggattgagaccagtctggccaacatggtgaaaccccgtctctacaaaaaaatacaa

SEQ ID NO: 390106 - DNA, 478 bp, Homo sapiens
ttgtgctaggaggctttgagtcttgagggagtgagtaaagggtggaagacagactaaatacatagtttctaagaaactgatcctttgtctcaaatgttgggaggtcagtagtggaatttaaataaggcaacctataaagcattttatacggggataagccgatatctttctagtgagcagttcagactcttaatagggtaacgggaaaacacttagtccatggtaatcgagtttctagaattaattttttttaattaagtttagaaaagtttctttagttataaaagtaatcaaatcccttttcacaatggaaagttctacatgatcttaagaactaaaatatcatgatttgaaaagcaatatggaaagttatttgcagtacaaactctatcacattcacttaaaaagcagccaaagttgcttttttctaggtatacaggcaacattccacaccattcaatactacctcccttttgtg

SEQ ID NO: 390107 - DNA, 233 bp, Homo sapiens
aacgttttagtgagttacaaggaaaatagccatcaaaagtccatataggttactctgtggatgggttggggagccatcttctggtcttcatccagacttgattgacttaaaattgagtatataagagtgtaaaagatggtaagtgataggcttgaggcagagacacaggcctgcagccagaactggaaaaaaacccacaagtatgaaaagtataggcaaaactataaagcagc

SEQ ID NO: 390108 - DNA, 1449 bp, Homo sapiens
ttgatggtcctgcatagggagtagaagaaaaaggacggaggaggacatgagatggtcagatagcctagggcctgtaagccattataacgattttgtcttttaatatagagaaatattaagaggtttttgttttaactttttaacatagaaaaatgtaatcatatacaaacacagaatagtataatgagcccccttgcactaatcactcagctttaacagctttcactttgggaggatatggagtgaaggagtgataagacatggcatggcatgacatggcttgaacaggatcactcaggaaaataagccatggggagacaggacaagcagaggaaacacaggagcaaaagcttaggagacagatgatggtggctggaaaccaagggagtagcagtgaaggtggtgagaagtgatcagatagaggatatttttttgaagatttgaattaatattatatatattatactttaaagaagaatttgaaaatgcatgtagtgtagtaaagatggtaagaaatacagaaaagaggccaggcacagtggctcatgccagtaatcctagcactttaggaggcttaggtgggaagctcccttgaggccatgagttcaaggccagcccgggcaacatagtgagactctgtctatatggaaaaaaaaattaaccaggtgtggtggcatgcacctgtagtcctagctacctaggaggctgaggcaggaagattgcctgagccaggaggttgagtcttcagtgagccatgatcataccactgtactccagcctgaatggcagagcaagaccctgtccctttaaaaaaaaaaaaaaagaaagaaagaaaaagaaatataagaaatggcactagaatatcagtattatatacattattttctgtttaaaaatccacacaactggcaaaaaaaagtgacatacatgaacatttataagacagtgcatttataaattacaaactctctgctcctcccatattattttgcagtgatgaatgattaggccatccaaacgtaaagatttatttgtaatttgctaatgatggaatgacacctgttgaggtacaagttcccagcaattcttggaattagcaatagtgtgttacttctttctcgaaagaagcatgatttgtaagcagctatatctgatgtagtaaaactgaaagttaaaataaaaaaggaaaccgtgggtcaaagtatgagggaaaagataaaactttcagagcaaagttatacatagagattttattcatcgtctctgtgtaactcacgagaacttcttagcttatttattatgtcaaatggcagtttgctcttctaatcccagcctgatatcatgagccatatatgctgttggtcattcaaaaagggcactaaacaaggtgaaagaatgtcagtgaatcaatgcaactccatgagtactaccaggaaaagaaaaacaaaa

SEQ ID NO: 390109 - DNA, 565 bp, Homo sapiens
tatataaacatatgacaaataagaatcttgattatttgggtgaagaaagaaaacaaaatcacgaatttaaatttccagggctctattttatgtttttcagcaaggtcatttgaatataaaatatttaataaggacctcaaatcatattctcttgttcaagtactttaaaagttgattccagagcccttaaaatgtatgaaggatgcttttccagactgagtcataagaagtcctaaaagccaaagaatttaaagggttgtaaagcaaatagccagagaagtgtcagacctgttttatttttgatgttaccttctgaaggaatttctcctgggaagtttttccatttgtatttcgatctcaaaactaaatttggaaaaatcatcttgttcatattatcagtctggatgtgcatattcatatctcaaaagtattaattggaggcagatcaccagtagaaattaaattcaaatgaaaaataatgttgatacactttatgcttttgctattgattttttagccttaaaagattggtaaaatattagtattttcctttttcccttgcatg

SEQ ID NO: 390110 - DNA, 864 bp, Homo sapiens
gcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaa

SEQ ID NO: 390111 - DNA, 677 bp, Homo sapiens
gcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaaagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataa

SEQ ID NO: 390112 - DNA, 464 bp, Homo sapiens
caggggacccaggaggcaacatcccaacagactgtgagcagcactcagggagtgagtgcctggtcttgaggtgaggccagggcctgaccaatcagttgcgggttaggtgctcccccgtctgggggtctgatgaagccctcctaaggagatctcaggaggaggaagaccccaaggtctgcggattcctggaactgaggaaggggcaggaggacatgtctcaggtctgagagaatctgacgtgggcccagacatggggagggtcccaagtctggtgaaaccaatggagagttcttcagggtctgaaaagggctggtggcagtccctgatctagggacgacaggtcatggggaggaaggacccaggccttctccgagtcatgaggggcttccggatcccagacgggccggtcacgggcttcaagtctgggagtgttcggggtccgccaggagccggtcacgacgggc

SEQ ID NO: 390113 - DNA, 598 bp, Homo sapiens
tgaacctttaccattgaaagaacaaaggggtggggcccgagggacccttccctgccgtcccgtggtgtgtagtcagggatgctcctgcagacacacaggtgggctctgactgccagatcgcaggggcggtgccgtggtcctcacctgccatgtcactagcgtgctgacgcagacaccggcgagagctacagtgctcggcccggcacatcccagacaattcctctgtaaatgctgcagcagccagaggccccagcaccttgaggttaagcaaagagaaggaatagagttctccagagccccaaggagcgggagggtctgtcccaatggatgggctcagccaatttcaccctctcctccccctgccaacactgcggcctgcagcctggacctggcccgggttgtggaggggaccggggatgcagctgccacctgctgggcggacgtgggcctaggtggtcctcagccctcatgacaggagcccccgaagcactgttgcggcaccctctctgacattgggtgggagactctgggagccgagtgcagagccagggcccagcacgaaggccttgggctccagtccgtgtgccccacatcccta

SEQ ID NO: 390114 - DNA, 525 bp, Homo sapiens
ggcctgtgaatacagctgactgtatacagggttactgttggggttattgtggggcagtgtaaggtgatgaagatctcactgacttagtgttgatggcttgagtttgagtcctggtattaccactcgtttgttgataatcttaggtaaataaactggcattgctaagccccagaaaaatgtatttagtggaacagatgaaatatgattcagtggttaggaagttaacttctgaagacagacaaacctaagtttgaatcatggttcaccccttagtggctttgtggccttgggcaagtttctttaattttcttatctatactgtgaacagtacttacatcataggtttggtctgaagattctgtgagataatgcatatcaagtggttagcactttgccaggcacattgttaagtgcccaataaatgtgggccaaatgtgatagctcacccctgtaatgccagagctttgggaggatcctttgagatcaccctgggcaatatagcaaaatcccatctctagcaaaaaa

SEQ ID NO: 390115 - DNA, 592 bp, Homo sapiens
cctcctcagcctcccaaagtactgggattacaggtgtgagccaccatgccctgccggcttctccccagagctttatgccatgcctttgatgggcacctcttacctcctcccagcctaggaacttgcatgaaagggaactatgtccaagtcagttttgtgtccctagcaccagggaagaggatgggggttgctgagagggacaggaaaggattggggttgtgctgtgtgccctggcgcctctaccaagcagaaaccagccttccctgtctgctactgtgaaagcccaaggttgcccttctttgggggagttgaaagaaagcgggtgtttgttcagcacacttgggagcactgtgtgccagggctgggagatcttgggtgagggtactcaccatgctcattaccttgtaatggggttaggggtagcctgtccctatggaagcttgtccttgttcccagggagggtcaggagcatgggttgtgaagtcaggtagatctgagcttgaatcctggctctgccttttcatagctgtgtgtgcttgggccagcaatgtggtgtctctgagccttggtgccttattctacagagggatga

SEQ ID NO: 390116 - DNA, 483 bp, Homo sapiens
ggcaatttcattcctcacagtaagtgacgttttttgcagttcttctcgttgtctacccttcaggaatgtcttcgttcagttcatccacttttcatctgaattattcaaaaaaatgcaatagcagactggatgcagatgataaacaacaggggtttcaggagatctgcacagtttcagggtctgtccctgtagtagggtcacttattactttctccttcccttttttttttcaaacatctatattcttcaaattgttttcttgtagaaagaaaaaaacaaacaaactgtgaactcctctccaataaagtaagaaacaaggtttgttacccattttctttttcttttcaaccaaagacagaggccatctttgtgatctgtccttgctggagattatatatttcctctactctgaatcagccactagaaaggttaaaaaaaagagaaagacagagagacagagagagagagagacagagtggggga

SEQ ID NO: 390117 - DNA, 144 bp, Homo sapiens
ggagaaatgtaactcagcacccctcacgcagcaacacagacacactctgcacacgcatgtactccaaagctctcagcatccccagaaacacaaatccggggggctcagaggcgcacaaacaccagcacagctgccagccatcct

SEQ ID NO: 390118 - DNA, 468 bp, Homo sapiens
acacacacacatatacacgcatgcatatacacacatacgtgtgtacgtactctcacttatgcaaatgtgctatcttcaaagactcatgggcccatggcagctgcagtctcagtacataaaggggacttgaagtcagaaagggccaggcagcacaaggaggtcacgaagagcctgattcctgggccagactgcccaggatttcatggtttctgttgccttgtttctactttttaacttgacattattgacaatatatagttgtccctaagtatctatggggggtaccaaaattcttagctactcaagacccttatataaaatgccatagtgtttgcatgtaacttatgcacatctgcttgaatactttaaataatctctagatgacttatgacacctgatacaaggtaaatgctatgtaagtaattgttatactgtgttgttttttatttatgttatcttttgttgcac

SEQ ID NO: 390119 - DNA, 2153 bp, Homo sapiens
gaaaaacacaggctccctacgcgctgaaggaggcttggcccttgcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctag

SEQ ID NO: 390120 - DNA, 3251 bp, Homo sapiens
gaaaaacacaggctccctacgcgctgaaggaggcttggcccttgcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggccaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagcaaaaaaacaccacacaacaccacccccaccccttagaccccactcgcccccaacaacttttctacacaacccttataccccctcgtccccctctcacaatcc

SEQ ID NO: 390121 - DNA, 2895 bp, Homo sapiens
  misc_feature (12)..(12): n is a, c, g, or t
gtttccactcgnaagcatatatgtcgtgtgtgctggcgagggatagtactgtacttcatgtaggctcaatggtcgtaagcatagtgttccctgcaataccaagcctctctatgctaagcaggagtgattgacgattctgatgatctgcccatatagatgagtcgatagttaatatcgagataatctcggagtgaccctgcgttaatgctctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggccaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 390122 - DNA, 2843 bp, Homo sapiens
tctcccagggcctggcatgcagtacatcaacccaaggtggcctttgaaattgtatttccatttcagcgtccagcccaaccctagggctagtgggagggaagtctctgttactttgtaccagctcaaaagattggtgtaggagtgcctggtcctttggtcttctgattgacatgcattcacactatacatgttgaagtcaccccacgctctctactagacgcctgtgccactgagtccccatgaagcgaagtcatggccacgttcccgcaggtggcacagagggcaggagcacactgtccccacagtgcccatctgtctggtgaggaaattcacatcgtcccccttccatcctcagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggccaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 390123 - DNA, 994 bp, Homo sapiens
gaaaaacacaggctccctacgcgctgaaggaggcttggcccttgcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaaggaaaaaaacagcaagaagccaccgcagagcaagagaacaaacggtatg

SEQ ID NO: 390124 - DNA, 375 bp, Homo sapiens
gtctcagcttcttcatctgcaagatgaaaggtctgtcctccatggtagcccaacatacttccgagtgttattatcagtcccctccccggggactgccagagccagggcaggttggtcccaacaggcagccccttgcagcagagagagcctgggctctggtctcagacggacatgaattaggaacccagcttgtttatctcctttacttcctggctctgtgatcctgagcaaatcactttgtaatgcttaacgttgtttttactaaccttgttttttaatgccttaccttgtttttactaaccttgcttttagactctttttttccccttaatcacctagccttgtttccacatgaattagctctcccttagttga

SEQ ID NO: 390125 - DNA, 379 bp, Homo sapiens
actaaagaaggagcaggagaatctgttgaagcagcggtgggagctagagaggctggaggaagagcgaaagcagatggaagccttccggcagaaggcagagctggggtgtgtgtcagaagggccccccactcttcccaggcgggtgggcctcttgctttttcagacttgcattcgtgttgctgaaaccataaaggagacagcctggtcagcagttatctaacttctatttaattctttctgagatactgaaggcagcccacatttgattctccttcaggcgtttcttgagacatcagtataacgctcaactcagcagacgcacacagcagatccaagaggagctggtaagtctgaagagacagcctgacatctttcttag

SEQ ID NO: 390126 - DNA, 769 bp, Homo sapiens
ctgatctgatcactcttatgttttctttcttttctcagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaa

SEQ ID NO: 390127 - DNA, 3150 bp, Homo sapiens
gaaaaacacaggctccctacgcgctgaaggaggcttggcccttgcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggccaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 390128 - DNA, 3388 bp, Homo sapiens
gacgtgttcggggagcagcccaccttgtgggtggccaatccgggacgggaatcttaaacttttaactcttggtgcaaagactgatccactggcggctttacgggagcgggaaaaaagtatgtgaagcttgccacggtctcgagaccgaggtcacacgttagcagcctgccggctacatttggaccatagacgcagagtgtttgcccccaaaactggaggacctccagaatgagattcttggcgtgcaccaggccttttcgctcattcagccggcgttcctacccaggcactgcatcgaccctacacttgaggacagcttttgggtcaggggaattggtgcctggagtgagactgctctctgctttcaaggctccagctgtatccctacattgctcaggcaattcctctctctaggtctcagcttcttcatctgcaagatgaaagatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggccaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 390129 - DNA, 1064 bp, Homo sapiens
gaaaaacacaggctccctacgcgctgaaggaggcttggcccttgcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 390130 - DNA, 900 bp, Homo sapiens
gaaaaacacaggctccctacgcgctgaaggaggcttggcccttgcgacgctccgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagaggtgaaaatcagagatctccattgatttatctaagtagatgaaatcatgtttccagacacttttttttttgaacacgtatcttgtaccgggttgaaacagaggagggaaccttgagccacctgaaaagagcgccaggcagaagatctggcacaggctgcgctgagcggctcattcggttgttgaacaaatgttgattgaacctccgctgcctggtctgccaggtgcgggcatggagatt

SEQ ID NO: 390131 - DNA, 409 bp, Homo sapiens
acagaggaggtcactggaactcatccacaatatgaaatgccacatcaagaagaacacgaacataatcttaattatctaagcacccatgataaccaaagattctttcaaccacttttatttcaaaggatgaagtagaatcagtggagcacaggagcagagagaggcagggacaaaacgacttccctgttatgacacaaataatgactgttttgtgcctacagtgactgctgtggtagacactgctaaactatcctaagggactaagttattctatgtatgaagggtgtggggaacagtgttccattatctctaacacactcatctctactttcctggaaaaagaggcacaatcaggagagcaggcaggcccaaagtaggcacaaagttactgtctgtggccttgaacata

SEQ ID NO: 390132 - DNA, 517 bp, Homo sapiens
caagctgatcccactagcttagattgtcagataattagtttgtagagcttgtttttcctgggattgtgcaaaaggccaggggttcttctagaatgctctgaaatttttaaagttatttatttcctgaactttttccttattccacataagaatgtggattaggactttggactattttactggcaaatgttatagtctcagtatctgattttaatatataagatcaagttaaattgttttcatctgatgagattttgaccccctgggaacatttggcaatgtctggagacgtttttggatgcacaactggagcaggggggcttccagcatctagtggatagagggcaaggaagtccccctgctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtct

SEQ ID NO: 390133 - DNA, 336 bp, Homo sapiens
cagataattgcttttaatgacatgaatgttggtataacggtagtaagatcacgataagatctgtggctctttcaaggttgggattttgtttttaattaggataagttttcctccgctaagcgaatggcttgtctttttttcttttggacacggatttgttcaactgatcctctgctgtcatgttggatgcaagaaagcttgctcaattttcagattttagatcttcaaagcatacattttgctttttattccacttccgtccctagtataggttctagcgtgccattccctttgtctcatcttttgcacttatatcaaaaaaccatttatttattt

SEQ ID NO: 390134 - DNA, 633 bp, Homo sapiens
caggaactctcatgctagcaggatgaggtaatgactatttcccatactcgtgtcaactttgagcaatgctaggaatttccatatgtccaaacaactgtttatcaggaaatgcaacaaggtacttttgacactgagcgtgaaaggaactcattgaaccaaaatcttccaaaaagactggaacataagagagcggatgaagagcataatagaagagaagtgccagggaggaggattatcttaggcagagcacactgaggatggagagttaccagccctcccgagctgtcgttggcactgaaccaatgagagccattcatgtgcctgtctgtgccttgtgtttttcttcttcaacatatactttagaacatccattctgtgcaaagctctgtgcccacagctgttgagatgccagatgcatgctgttccctgccctgaagaccccagcagtcaggccagggagagaagacattcttagacaacccaacagtcgtccctggggaaagatgcccctccaagaggacaggaattggacccactttgggtagccttgtacaatgcaacccagcacccagcaacgtcctgaagaggctgctgactgctctggtcgaagtggagcagggcccttcctccctc

SEQ ID NO: 390135 - DNA, 309 bp, Homo sapiens
gtagacccctgtggcgacctacttaattcacacccggcatcctgacgtgtagactcctatgtagacctatttaattcacaccaggagtcctgatatgtagatccctgtggagacctacttaattcacacccggcatcctgatgtgtagactcctatgtagacctatttaattcacaccaggagtcctgatatgtagatccctgtggagacctacttaattcacacccggcatcttgacatgtagactcctatgtagacatacttaattcacattgagcatcctgacgtgtagacccctgtgtagaccta

SEQ ID NO: 390136 - DNA, 612 bp, Homo sapiens
tccagaaacttctcaggaaacccaagtttgaaggatggtgacacaggggagccaaggagagggcaggcctttcctgagtgctgagtctgcaggccctgcccaggaacagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcaaagtgtctgtgagaacaaatcccaggcactggggtgtagcctgattgttaaacatcaataaaggctcctggccgactgagca

SEQ ID NO: 390137 - DNA, 219 bp, Homo sapiens
tctggcagggcagagctggttccccgggagatagctcagtgtgtcgccttaccatagagcacccttttggggccaagcagagcagcaggcctgttctcctgcaccccacaggaggcaccttgggccatgggtgtccagcagcacgtgggtgggagaggcctgggagagggcccctccagagaggggctggctctggagtaataaccgcaacagctgcaa

SEQ ID NO: 390138 - DNA, 784 bp, Homo sapiens
cgccctttagcgagcgccaaaaaactcccgaccccttcttggcgcgcgtcgccgcagagcccacccaggcgggatagagcttatggattggctaatgccgcagcaactcccgcctgcctgagctgttcccggaggtccgcaagcccccagccctcccatgcggaagagtctggctggtgcagagggctcaacttttccctaggctctggacccaaaggccttccacgtcctttggaacctgcttacttcctttattccctcgcagtctggctccttcctccatcctgggtgaccagtgggtgccgacattgacattcatataagaacacggaggaggtgcaggtgggaggagatgggctcagttttagccaacttaaaatagagtctgcagagcccgtgggacacaggggaggtatttggggacccagagttggggaactgtgggtagatatgggagttgaagacactgacagcaaagggtgcaactacagttcacctagcatagaaccctatgtgaccgttaaaaagaatgaggctcagtgaagtgaactcatagggaaacctgcccacaacaaattagacgcaggatgcagtagaaggctaagagaagtctggagccagacttgggtttaaagcctgggactgacacttgctatgcgaccttgaactgattacttaacgttactctgtacttcggtttcccaatctgcaaagcggggataagcaattacatccttctgtttgatgtgaacattaaataaattaatccacataaagcactcaa

SEQ ID NO: 390139 - DNA, 316 bp, Homo sapiens
gtgtcgacttctgctctacattttgcctcctaaaattattatctagcatcaacactgactgtttcagtaacaccaaaggaagacacacctcagcaaagttaactctggttcttaaccaaggcacacagcagaaaccactaggggcccattcaaagtctacccaacccagtggatcaagggtctgtagtgagtgagggggagtggaaaattgccaatatctccacactattctgatcagttgctgcaacagtctgaatcaacgggccttcctttactggaaaaggttcattctccttcagtaaggtctaggtcgacg

SEQ ID NO: 390140 - DNA, 880 bp, Homo sapiens
agcggctgggactataagcctttcttttcacaggaaaccctcctaattggtctgataaactttctgggactcaaaatagaaccacagcacagccttgcatcccagggatgaagcagacttgatcatggtggatacgctttgtgatggactgcccaacagttttaaatgtaaattgaaagaccccagtactggtccaagccctgaagactgcacccaggaaagtggaggtatggacagaggcagccggtgcctgaggaagctccacggggcaggcaaggcccccacgtccagtctcagcccctcttttggccacatgccggagaaggaaattttgtgccttgaataatgaatccccctggagcccacggtacctgtacttctctttagtgtccactgagaataacgtgttcgacattcaagtgacaacactggaaagcatttcaaagccctggagccccagaacgctgtacaccccgacggctcttctgcctgccctctctttggcttccaaatgcagcaagctctttctttacttaaaatgtgttcatctttcacacgcatcctggatgtaccacagaaagacagtacagataggcaggctcttatttctgaagctgagctggtcccgcccagcacaaagctttaaagctgctaaggctccaggatattatccagtttttaaaaatggaaaaactgggaacagggaggctcaatatcttgtcccaggcccaaacaggcttttctggagtcagtatcattcaactggctcaggctggattttcataagaaaagataataaacatttactaatgtaataaaatagacaccttttaagtcacaagcagtatccaaacctttgggacattctatggtgctgaac

SEQ ID NO: 390141 - DNA, 526 bp, Homo sapiens
ttctttaaaattttctctctgagaaatgggcttgcctgtggtttgggacgtttctatgtagggataacaaacagaaccaaaatagcaaaacagatgttttgatataatctaagaattgcatcctctcaactgggaactgtcatgaagaggaagaactcataaaatttgggaagtttcttgactgaattctgtggtgcagagtagcagtgttgactactagccaatgaggaagatttgaatattgaaattactggctgggcctggtgattcatgcctgtaatcccagcactttgggaggcctaggtgggcagattgcttaagctcaggagtttgagaccagcctaggcaacatggtgaaaccctgtctctacaaaaattagccgggcattggtggtgtgcacccgtaatcccagctactggggaggctgaggtggaaggatagcttgagcctgcgaggtggaggttgcattgagctgagacggcaccactggactccagcctaggcaatagagccagaccttgtctc

SEQ ID NO: 390142 - DNA, 363 bp, Homo sapiens
tttagaggagtttctatttagtgagtatattccaattcttttgttacaaaatgttgtcaacatttcttattttactcagcaaaacaaaaagctgtgaattgcctattttcactatgctgttgattcattcaagaaatatttatttgttatactcatctacttctgggtattctgctaggtactggaataaataaagcacattgtctctcctttaggaacttaaaacattgcaagtttcaagggcagtaccatttacagcatatatgctgcatttagctatattcagcataccaacaaagcatagataattaatagtactgggaaatgatgtcaaaatttccaaatttttatgccaagagaaca

SEQ ID NO: 390143 - DNA, 347 bp, Homo sapiens
atggcatggggtgggctgtgttttcatcgagagcacaataagtctttatatttgctgctggttggagttagagatctgggtatcttatgaatctggatatgtgttacttcttaagcagtttttaaaccgctccccattttagccctcatccttccttctgaagacacctcgccgttgggggaattttgccgtgtaagtcaggttagttctaggctgtcttccctcctggcttcgaatttcattttctcaggtctgttttgtcatttcccgtgctgccaatattttgttgccattatcctctctcttgttttctcttgtctttgtgggcttgtctcttttaaggacag

SEQ ID NO: 390144 - DNA, 566 bp, Homo sapiens
aaacaggcaagaaagaggacagcacacgagtatctgaagaaaaggttgaaatgttactgtaataaaagcggaaataaatttctacacagcttctttagaaatggtccgggagagagacagaagaagtaaaaggatgaggccatatcccagaagccaagaaggcagattctgtcgaagagggtgacagggtgccctacactgtaaaatgcttcaaacagatttaggagagtgaggaccaaaaagctgtgaccttgacaaccagaaattcacagtgacctttgaggaaacagttttctcaagatgtggaaatggaagtcagaatgcaaagagttgaggagcaagtgcatggtggtgaagccaacctattttttaattaaccagggtcaatgtactttaaaagtcttcagaatgcctgtaagtttcctttactagttccatgtactttcttgttttcccataaaaatctggatttgtggcagaagagaatgaaaaaaattaaaaattaaaagcgctgcttttccttaagcactgacaaaatacaataaaagctgattcttattaagttg

SEQ ID NO: 390145 - DNA, 664 bp, Homo sapiens
gtcatgtgagatatccaggcagacagtaggcctggctcactaacaggcaaagcaatcattcaactcatattcatttataatgggcctttgggagtaactaataaattaccaaaattgcaagtgttgaatctgcaaatgtcaaagacttccagtggattctttgacaacatgtacgtagtcgtcatttgtcagttttcttggggaatttatcttctcctggtgggcagcaggaaacggatcccactacagacattaaccatgcccaatattcacttttgcatgtccctaggcagctagggcagcttgaccaatcagctgcatttgcttaggatttctgaggctggaggtgaggatggaaaaaattctttacagtggttgcagcagtggcagcagtatccagtgtccagacgccttgccactggggtcagcatggcatccagcatccaacgccagctgtggctgtgacaaaggcagcagcactgggcgttcagcagcagcagcactgaggctgtcctcacctatctggctctgtgatggaatttggtgtaattctaggtacctggtctctgtttctgcttttttcccaagccttgtttctacagccttcaagtgattctgtaacttactcaatgtgctttcaataaaattcatttcctgatttaaa

SEQ ID NO: 390146 - DNA, 216 bp, Homo sapiens
agagaggtgtcttcacgtactggcccttccttgactagctcctgggaaatgacctgagctcgtggaatttccagtttgataatagtgttctagtatgcctgaggccttgggctgcattttgttagtttgacgagatagtttatgctaacagtatgaatcatggcgaatgtctgtttttgaatggctgaagccctgggccatgaggtatcactacac

SEQ ID NO: 390147 - DNA, 334 bp, Homo sapiens
tttttgtctgttttattcacttctgcatccctggtgtctagaatagttcctggtatatagtagatgttcaataaatatttgttgaatgaatgaattctctgtgtataaggcagttctgtaaagcccctaaatcttccttctccaagaagccctccttcaaatgtatgtaaccttatttagttattgcacatccccattttacagatgatgaaactaacgctggaaaaacttgtccagagtcactgacctgaaaagtggcagggccagatgcatttgtttatccaagaaaccctgagagggctgggcatggtggctggcacccgtgatcccagca

SEQ ID NO: 390148 - DNA, 248 bp, Homo sapiens
tttactgccataatccactgttatcagtaggattgtataatgttcctcaaatgtgttgaattggaaaagtttaagaatgattgatttagaaataagatgatgtcttctcagtataatctatagccatattcaagtagaaacaacaaatactcggaaatggtagtgattaaagggtgagtagagaaaagaaaagactaaaatgagccctttcgcatctagtaagtcacatcttcattaatatcagatct

SEQ ID NO: 390149 - DNA, 359 bp, Homo sapiens
aaacagaaatcactctaggtatttcaagcagaaagggattgcatataaggaattatatgcttccaaaattactgggaaggctaaggcagtagatggtgggaactgtggtgtccaaggacacactccactgtagcagcagtccggaggtcaggaatgactcttgctgggcaccacacttcaccacagtcatctctaaacaccaacaagatggtgaccaagatactgaaatgctgaatacagctgcctcactgctggtcattctgaacactcacattaatcaaagattacatatacccagatggtatccgattagcatagatctgctaggaatcatcatagccagacgtaggcaagacagg

SEQ ID NO: 390150 - DNA, 126 bp, Homo sapiens
aaaaaaacgaagcagttgctctccactcaccctcctggccctgctggggagccaactccagggacgccaatgctgtgcccaggctgcacagacggcctcggcaggtgtgggtgaggcagggcccta

SEQ ID NO: 390151 - DNA, 239 bp, Homo sapiens
aatataagacaaaaaggtcccaggtcaaacttatagctaacataaagtcatacttaacacaatatcacattgaaatgtgaatgattacaattagaagttttaaaaattgtttcactatccctcatatcaactaacatacagcctttgtaataaaattaaatgagtaggaaaaaatagaaacccatagactatattcctattctcttctttgagaatataaaccaactaggtttaatata

SEQ ID NO: 390152 - DNA, 216 bp, Homo sapiens
agattacacggcagtgcgaaacaatctgcaagcttcccaccagctcgcccctgcaatctggaaagagctgctggtagggaggtaaagtgcaaaaacagtgtattccccagaggaacaggggttgtgggaagggggtggcttggacgtcacggcaaggaaaggtgttaagagttaggtaccaactggccaggcgcggtggctcacacctgtaatccc

SEQ ID NO: 390153 - DNA, 445 bp, Homo sapiens
acaaaaggcatgtttctcatttgaggaaatgattacattgagccatggaaaagttcctgggaggaaaaaaaaaaaacaaaaaacaaattgaaagtcagcagccatcagacgatcagagtgtttatttcacaaatgatcagctatttaaaaagtactctcggccgggcgcggtggctcacgcctgtaatcccagcactttgggaggccgaggcgggcggatcacgaggtcaggagatcgagaccatcctggctaacacggtgaaaccccgtctctactaaaaatacaaaaagttagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaa

SEQ ID NO: 390154 - DNA, 876 bp, Homo sapiens
tcatcagtgaaagagatcttaacgggtgaagagaagacattgaaacacaagtgctagttacgtttaaatgcaggatggaccgagataggaggatttttttcttttaaataattggccatagtaaaaggtaaaaaggtaaaaacttgaatgtgaggactcatttgcacttcatattttgcttaatatgctgagagctgcaagagaggaggatctggtgtttcatcttagagcaaatcatacttgatagtaagagacagaaagtcataaaagcgtgatgttcagcaggcaggacatttaaatcatacagctcataatgatgttagttgatggtgttacatggttccatggctttttcctaagtgtgtttataagaaattggaacgaggatgttttctgtggcattttcttccaggagctcggttctgctaattgcttggtttgaataagtgctctctttccagttggtctataacatttcttttactatctaagaaattatgaagaaatagattgattaatttgaaaattacatttaagagtattttcctgtaaaattgttggttctgtgaaaaacaattcctgttatttcttctctaaatacaatgagaattttttttgttcttatattgaaatagctctttgatttcctaaattgctgtgctgctttttaaaggacggcatggtttcagaagctattaggttggtgcaaatgtatttgcggtttttgcattgttgaaatttgctgtttgatattggaatacactcttaaatcaatgtggttatgccacacatcattttaatgtgaatttctcactttatgcttttttgcgactgagttattacttgccgtttaagtttattttagactgtggaaaa

SEQ ID NO: 390155 - DNA, 426 bp, Homo sapiens
ttttcccacccttattccctaaccactcatttcccctcaccagaggaaccactgtttccatgggatatattagattgatttatatgaaattgccggtgtttgactatgatgatttcatgtggttcagcctaatatcagtgaaaaaacagagtcctatcttcatggagtttttattctagtgggaagtgtattacttaattattgcagtgtaacaaataaccccaaaatttagtggcttaaagcaacaaacatttattatctcacatttcctatgactcaataatttgggagcagcttagatgggtagttctggctcagggtgtctcatgaagttgtagtcaatatggtgtctggggatgtagtagtttaaaggcttaacttaggtctgaaggagcagtttccaaggtggttcacttacctggctat

SEQ ID NO: 390156 - DNA, 795 bp, Homo sapiens
gttgcacctttttttgagtttgaaatgatggtccttgcttgatttaaattgttttttctttgaatgcctatgaccaaaatatctccccgttaagccagcttctaggcccagaaaaatgaaagttgccttgggacaaaacaggaaaacaggatccatcaccattctaaaccatcagctttgtaaagacatctgagatgattatggcacaagaggcacagagagtaagtggatcttagtccagcagaatgattcctcctgggaccagaaaattcttctcattcttaattttctttatttgttttgcttcctataattactttaaaaattataatgtaaaatattttcaacagaccaaatatgagtaaggatatcatgaacactcatgttatgaatattctgcttaagaaatgatcatcaaaacgatgaaggccccaggtacctcatgctgatcacattcttcttaatgtcctcccaaactagaaaaagttactgccctcagaaagagtttcttatccctaagaacttctttatatttaatcatatagttatatcatcccaaataataggcagaatggttttaaaattgtcaaatatgcacatttccaatttcattaagcagagaacatatattttcacccataattatgttttgaaactcactcatgttgatacctattttactcttttatagtatacattgtataatgttgatggacatttagcttgtggtacattcttattttcttttatcttgttttttttttgctattataaacatagctgataggaatattt

SEQ ID NO: 390157 - DNA, 275 bp, Homo sapiens
attgcttcggcctggccgggagagcggaagggcctggtgtgggagagtcccttgcactgccaagacggggccactggaaggtatttgggtggaagaaagccagtaagcccatggggctggctgggggcaggaccacgcgttatgaccaccgtcctgttcctacccccaggagccccgtttgaccccgtgcggctactgggtaatgctgtatccagtgttacctgttcttgtcttcgggaaccgctatggctacggggacccggagttcctgaggt

SEQ ID NO: 390158 - DNA, 665 bp, Homo sapiens
ataaattcacattaaaacttgtccaaaaacaaaggagttttcttgtgagaagcagctgctcattctggggcattcaagtgcagtgagatgacaacgatgaccattggagatgctttcaaagtgatgccggcactagacagatggctggagtgtgtaccctttaaggactcacctatctcagaagtcatgtgtgtttctgtatgtgtaaatgcacaaacagactggaaggatatgtgttcagcgtcttttcagactgtgaaggtccctgcaaccagaaggagagctgtcttcaggaaaggatgaagggaacgagcatctgtctgtgactctggtggttgtgcaggcaggtcacctcaaggtggagtgacactgtggtgggacaggtggagcaccagtgaggaagctctcatgggcctgagccaactgaattaattaagaccaagaacagtaaagggacccagagggcaaactctgagaggcagtcataagcagcaccctctccccaaactgtattactcattcccacagaagtgtgtgtctgcttgcctttaatctgttctgactgtaagccattttgagacatcccagtcccaatgatggccaccatgttctgcattgaatagatgcttgacatacatccaattagtaaaagcgagtgaactaaa

SEQ ID NO: 390159 - DNA, 262 bp, Homo sapiens
cctactccattctaagggattcggctagtcactatttagctgtgaatccagcagccaaaaacgattgctatgtgttcagtcaacaagtgaaacaaagtacacaagctttctttatattagtgaagccagttctagaccatcctggctaacatggtgaaactaacaatacaaattaacaatacaaaaactaaaaatgcaaaaaaattagccgggcatggtggcgggtgcctgtagtcccagctactcgggaggctgaggcagg

SEQ ID NO: 390160 - DNA, 498 bp, Homo sapiens
tactttcacagggtcttgccagctggtaaggagcttgaaccctattttgaggtgggaggagccactggagagtactgagaagggcagtgacatggtcagatgggtctgcgtttgagaaagacaaactggggaaggaatagcatttgaaaggggcaggagcagtaagaatgtaaatgaaggccaggcacggtggctcacgcctggccaaacctatggttttatttatgtatattttagatttatttgttatatgtacttagttatatcttatatccctggaggctagaagagtgcctggcatagagtgcctgctcagtaagaatttgcagggtaagtacaggaatacagtggaaaaacaagaagcgtggtgctaatgaactacaacaggaactccaggtcaagatcatggactaagacatgtaaaggcctagatttcaggtttgcaaaaacaaatccccaaatataaggtcatttccaaattcccccgttggaaaagta

SEQ ID NO: 390161 - DNA, 123 bp, Homo sapiens
aacggcataaacatggttggaacgcacctgtgttgcatagatacgaggctcttcctgatttattgcctgtgcgtgtgttcaggcgtctgtcctggcatttgcctaagcctgctattgaaactg

SEQ ID NO: 390162 - DNA, 774 bp, Homo sapiens
aagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttatt

SEQ ID NO: 390163 - DNA, 401 bp, Homo sapiens
cctccggtcctggcaaaccccaggctggctgggttgatattgccccagaaagcagaggaaccccacagggccatcccttcaagctcagcccgacaagaagccaacagaaagcatgtcatttggatgcaggacacagagcggtcttctctgtgagcaccagctctcatctgcttttaagagttgtggggaagaaaatgaggcaagtaaccttttcagaggaagtatttttaagatattaacatgttttccaacagcaatgtttttgaagactcagtctaattcatattcgtgtgtagcttctaaaataacctatattttcacaaactgttttcttggtaaaattttcaaaacattctcaaggaagatgcattctgtggcaatgggatgccaataaaactaaa

SEQ ID NO: 390164 - DNA, 111 bp, Homo sapiens
gtagtgagcgttcttgggcctgtctctttgtgcccctgttgggatgctactccagaaaacagacccagcggtggcctcaccatatcataggcttgcttgatttcatctctg

SEQ ID NO: 390165 - DNA, 596 bp, Homo sapiens
aaatatggcttacaccagatgctcccaccaaaattcatacataactgcaaatttttgatcctcctttttcctcctaccctagggaaaaagtctatcttttggtattctttctgtgcctctcatttagcttataaaaacaatacacaagggcaactttcatgaggctctggctccaaatgccacctgccaagtgctcgaagacaatactaagaggaaaaagccagtctcatttatacaggtcagagaaggctttaatgagtgataacacaggaaaggaaataaaagcttatagttagcagcattcaaggagatgaagtagcttagggagagggagattaacccaaaatgagtttgtaacctactgtttggcttccaaatgacacttgggatgcttttatgatctcagctatgggaataccacaatggggtcacacctccctggatcacaaaagctacacagtagggctaacacacagccccacccacttaaatgttcatcagagaattagctataacctcaaaggaaagctgaatgtccaaagggtaccaaggttacctcatggcacccaataaaagggtaccatgtgctcagctcc

SEQ ID NO: 390166 - DNA, 559 bp, Homo sapiens
tccaccggggattgtatgtagaactgctattattcatcccaccggcaggttgtactccaccggcaggttgtactccaccggcaggttgtactccaccggcaggttgtactccaccggcaggttgtactccaccggcaggttgtactccacctggcaggttgtactccacctggcaggttgtactcaggttattatttaaagttcttaggatgctgattctgtattactgtggattatctcttccaatgccttgcaattttaaattgtgagttcattttcagcttttttccctccactgctaccctctccatgggagtcctatgtaccctggattagaagagttcctgtggagcagagtctgtttactcatgacagatgcctcagggatttcccttgtctaagcccagttattgtgggaattttacaccacatggctattctaattttggtctccatacccatgtggcaaaggcttgaagtttctatttctcttgcgaaactccctaaccctcaccagatctctggggagacatgtcactttgaagtttccctgtggcat

SEQ ID NO: 390167 - DNA, 523 bp, Homo sapiens
tggcaatcacttaggaacgtggtaaggcttttaactatcaataatgctaccctttctttaagaatgtgattttatgtagacattaagactcaggcagatctagcttaaaatctacgtttagccactaactagctacatatgcctgggcagcttgtccacctctctaagcttcagtttctacgtccattgcacagggcactgacaccttgcgggatactgcgagtattaggaacagactgcaccaagtgccccgtagtgcatgcttggcctgtagcaatgcttaacacggggaagaacccttgttcttccttcccttcagaactgcttgccaccaaagtaattgcagcttctgaaaaaacaattcctacttcacgagcaggacacagcattagtaacagtgctggccggcatcacacgtggagctctaccgttctccatgtgctttgtcacagcatgtttcaaagctgtttttcacaaattagaatgttgtttagaagtctggattagaagtattagaaagagt

SEQ ID NO: 390168 - DNA, 544 bp, Homo sapiens
tagaggtgaccatccattgaagatctttattcacggagagtcccagtagcacaaagagttccagtactggatagctgaaaaaccatttccttctggcctaggaactcctgtttagttatgcagccatccctgacacacatattcagatgtacctctctaatcctgcctttctgggtcccttgctaacctcggcactaagcgatccaagtggaaattattcacagcagtgactcaattgagttatcaatttgtattgaaggaggttctttaggagcagactgtcaatctaaagagccaaaaaatcaaaataaaacattgtaggttcgttgggtgtgtagtgattacagccttgggaatgctccgtggggcctctggaatgtgtagagggcatctgcacttaattgtgtttttccctgtgctgcttctgtcccatccactttacaaaaaatgggtcttaacctggagtctatgaacctctgcaatgacatgcaaaatgtcatatgtttatacttttcttgggtgaagatccctaggtttggacaaa

SEQ ID NO: 390169 - DNA, 678 bp, Homo sapiens
cagtgactcttatcctgcccgccagttccaagggtttctaactttttgtcttggaaaggaaaaccactacctgtaagtatctgttttatgtgtttcttttcattgtgactgtgaatgttctgttagcagaatgccccagagattgtttgtgtgatatcattaatgccaagtaacaatgcaaagcatctgcaagagtaggcttgcaaaagtttaactctcctgttaactcagaagatggcaacttgcagtgttaacaaaccaaatgccaaaactgagattctttttattacgtgacacaaatttctaactcttctcagtccatccgtgctggcacttgccaatgaaataaccattttttaactgtgtaattgtttcctctgaaattagaatgtttcttctcagctaaatgaaatggcaaagggaaaagacacaaaaatgaacagaacagataatatcctcatggtacaaacatagagaaatttggatgagataatgtctggatacctttgcttaagtttagttatatttggagacatattttcaaaaacatgatttctgtttcattgtggggaagagagatagtgctggggaggcaaagaaatggccttgttctgaagtttttggactgatttttaggctctctctgctcagtactgagatttggtccagagactttgg

SEQ ID NO: 390170 - DNA, 834 bp, Homo sapiens
ggcttgagtccaccggtaaatgggtgttgcatggtgtggagtatgctgcttagtccgctttcagaagctcaagggtgacctgggagtgctttgactactcctagcagtaaaacgaatgcatttgcacttccagctgcatttcttcggcttcttgtacagtcttgagtctgggtcaacacatgagacgtccccaggtgcctctgcatttgctgaccaatggtcacttctgttgctgccatctaagagctcagagggagatccactcttgagtccagggccagaagcaggtgtgagctatggcacccggcctgactggtgtctttataagaagaggagatgaagacagagacacacacagaggaggcgtggggagagaccaaccctgccgtcaccttgatcctggacttccagcctccagaactaattcaggtgaagatgagctgaacctgctccctggccttcccctagtttctgtggcttgtgacagaaggtggaaaggaccaacatggaagagatgcatgaacaaactgcatgttttcagcaaacgtttccaagggttatcttagctggatgcgactgtactttggaagagtattttaggactccatgtctttatgaccctagcttctgctttaaagttgaagaactgagtcctgttatcagcttcatctctgtttggctcccaaagtaagggaattgttttgcaaaagtaagatgagttttatcagcaagctttgtagaaactttacccaaaaaggaaaaccagattcccactcaggctgttttgtaagagacggcacaaactctgggagtttgacctcaaagatgtatcac

SEQ ID NO: 390171 - DNA, 587 bp, Homo sapiens
gtgtcggatgctccaccacagcagggcgctggcctggactggtttcagcacatgaacagtgctcctgagtttgtggggaacagaacctcaggctgtgtctcactcagtccctccagaggacacggcacctagtccaggctcaagactccagcctccaggccacagctactgcaccatggccagcaagctccttggatgccttgtactctccatagactggtcccctgtccacaggcagctccctccttgacagatgtcaaggcctctgggtatccacctcccaacagagctggcaggcactagcagatcagttgactctacaatgcgcccctttccaaagagaaggcagagcagcctccaccccgcaggactccctatgcctccccagttgcctgcaccatccttctagtggtctctctcaccttggcccccatggcactggcccttcctggtgcctccactatccttctcccacccccacctcctgggggtactctacaggcttcactttccactcacatctgcagcactggcatctttctctgcagagctcaggaccctccaatccaattaccttccagcagctc

SEQ ID NO: 390172 - DNA, 177 bp, Homo sapiens
gttgtgaaccattaccacaatccagcataagaacatttccatcagcccagaaagcaacctcctgcctgcttgtatcaacccttgcctccgtctctagcccctggcagtcactgatctgctgtctctacagttttgctttctctagaaatgtcaaataaatacagatacaccttgtgg

SEQ ID NO: 390173 - DNA, 407 bp, Homo sapiens
ttatttcccctgagagccaaggagagacagacacattttcttgttgtttctttttgcttgttaaggaactttttctagtttgcacttagagcgtaaagatttggcctttgagcatctcagatttatgtgagagtctcagtcttaactccccaccttgtgcacacccaaggccttgtcttctacttccgtacggtttttaaaactcaaaactcttagttactatgattggcaaatgcctgcagggcagctgtggctgctacatccacttatcacttgtttttttccgtttttctctattttggggccctatatttataaaattttctttatttttgtgaaaggtcagcagtgcatttaagaagacaatttgcagtggggagttgtattgttgttattgttatttagtc

SEQ ID NO: 390174 - DNA, 455 bp, Homo sapiens
actttattggtttccatggaagcaaacactaatagtatttttattaaaaccattagccatttaaaaatacataaaaacaagtacacagaagcatacatatttccttttgcctcaggcttcagtacggcatacatggcactggttaccactgtggacttaaaatgctggggatcctctgagaattgtcctactgagaaggtaggaaatttaggctcattgtttagagcttttcctgtgggtgttgactctggcactccccaccatgcccacagtggggaggccaagacctgttggaaaggcactatcattgtctgctgttgagggcttgatgaacattcaagaaccacaggcttttacaatgaaccctgtggaagccccaagggttttgaagaaggtgtgggacaatgatcaaaactccactttagaaacatttttatggagccagacacaatgac

SEQ ID NO: 390175 - DNA, 336 bp, Homo sapiens
cctctccgcccggcagccaccccatctggttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgtctagctgatggttgttctagctgtatacacaaacacagaagatcct

SEQ ID NO: 390176 - DNA, 1831 bp, Homo sapiens
agcgttggggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgtctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgtagg

SEQ ID NO: 390177 - DNA, 1834 bp, Homo sapiens
agcgttggggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgtctagctataacggatagttgcttctaagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgtagg

SEQ ID NO: 390178 - DNA, 1229 bp, Homo sapiens
agcgttggggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgtctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggtagagcagttagacaataaaatagatactagaaattgaaagtacgaatggctctaaaagtgaaatcaatctaaaaaatacaacaaaaatgatatccaatggcagaagaaagaagagaaaataagagaaagaggacaatacaaagattagcgagccaga

SEQ ID NO: 390179 - DNA, 1794 bp, Homo sapiens
agcgttggggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgtctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaattt

SEQ ID NO: 390180 - DNA, 1903 bp, Homo sapiens
agcgttggggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatctaaggatggttgtctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgtagg

SEQ ID NO: 390181 - DNA, 1839 bp, Homo sapiens
agcgttggggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgtctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgtagg

SEQ ID NO: 390182 - DNA, 1777 bp, Homo sapiens
cctctccgcccggcagccaccccatctggttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatggatgctaggatgttatgatgctttacagaaaaaatatctaaggatggttgtctagctgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaagaattggtgctttacctttactatgcttttttttacaggacaaaaagactgatttttaaagtatggcattttttgcagcataaataaaatattgttcagtacgtagg

SEQ ID NO: 390183 - DNA, 355 bp, Homo sapiens
tttgtggttaaaatggaattatacaaagctgaacgggatattttcttctatgctatgtgacattatattcttgtggccccaaaagaaaactctaaatttagctccttatttacactgaaaaagaaaatcatgttaaatttagtgccgtcttcatgctgtggtctttccatacaactactgttgactaccagatgtctctacttcctcaaattttactggttaggctggaatatctttcaattatgtttacagtttgagtttaattttaatcactgtttgtatttttatataatctatatccttgcatattttttgtacatttgtttttcatataggcttgttgctgaccttaggt

SEQ ID NO: 390184 - DNA, 282 bp, Homo sapiens
gcctcccaaggaactgggattacaggcgcccaccacacgcccgactaattttgtattttgggtagagactgggtttcaccatgttgtctaggctggtctcaaactcctgacctcaagtgatccgcccgcctcagcctcccaaagtgctgggattacaggcatgagccaccgcgcctggctgtaaaatatttttaatatatttaagttctgagggaaaaaaccttgaatttaataatcctctagtgacttgagagaacaaatattatggaatcttggatttat

SEQ ID NO: 390185 - DNA, 500 bp, Homo sapiens
tggagacagagtctcactccgtcacccaggctggggtgcagtggcacaatcttgggttactgcaacctctgcctcccaggttcaagtgattcttgtaccttggcctcccgagtagctggaattacaggcatacgccttcccacccagctaatttttgtatttttagtagagacagggtcttgtcatgttggccaggctggtctcgaactcctgacctcaagttatccacccgccttggcctcccaaagtgctgggattacaggtgtgagccaccgcacgcagcctaaatatgttctatatgttcaagaaggtagaagaaaatataaaataatgaagaaattgaagggataagaagacctacatggaacttctagagaaaaaaatataatgtataaaaaatgtactggaaagaatcaacataacagaaaaaaagatcagtgattctgaaaacagtaatggaaactagccaaaaggaagcagagaaggaaaaaagactgggg

SEQ ID NO: 390186 - DNA, 719 bp, Homo sapiens
aacttaggccttctgtcagtccaatagcctttccacttaattccctcacttctatgaatttctacagcatttaaagtctaagatcacagccttagagctttttctatccctcttttatagacgtggttgaaattacaatttcttaaagagcaagaactgaacctgataggacagtctcatgacttcttggtcagtctttggatctagagtagatacatgtagactcaggaaatcaacagaaactcttccctactcctcaccactagtcaccagaaacaaatcccagttccaggtacttggacctctgtggcaatgtcttaattattaaccactggcaaataactgccaggtctaaagaacaaacttcagcagttcccagactcagaagagatcctggttattagccatttgcaatcattacaacagtcaaatttcaggagcacaaacagaggtctttaagaataccaaacgtcaaatttaaaatataaaaaggataactatagagacagtctagtaacagcttcccccttcctgtaacattgttaccactacttgtggctctcagcaatttaaacaactaaaactcctgacaggtgatgatgttagagctgttctacttacaaaggagacacagttacattaaaaaataataatttaagcatcatcctaataacgcatgagccaagcgaaagataggttttgcaagcactgtaatagct

SEQ ID NO: 390187 - DNA, 111 bp, Homo sapiens
gtttcatctattctctcaatatgtcacttcaaatatgatcaggaaagaagtcttaaacatggctggaaatgtgggggcaacaaatacattagtgaacaccctggcggatcc

SEQ ID NO: 390188 - DNA, 526 bp, Homo sapiens
ttccacaatggttgaactagtttacactcccaccaacagtgtaaaagcgttcctatttctccacatcctctccagcatctgttgtttcctgactttttaatgatcgccattctaactggcgtgagatggactttttaaaaagcaacgatgaacatcatgattatatcctgtacgttgccacccatttttccagggaaggaaagaggagaaacctactataaactattccccctggcttcctgtacttcccctttgctctggcatcagcttttacgtgtgcaacaaaacatctccaaactcagtaggaaaactgagctgggtgtgatggctcacacctgtaaacctagcactttgggaggctgaggtgggatgattgcctgagcacagaagtttgagatcagcctgggtaacatggtgaaacctcatttctacaaaagataacaaaaattagccaggcatggtggtgtgcatctgtagtcctagctaataggcaagctaaggtgggaggattgcttgagtccaggag

SEQ ID NO: 390189 - DNA, 470 bp, Homo sapiens
aggcccttcaagtcacaacatgcatcactgtgtgcctcagatacagaggctgaccccatgccagccacggggcggctgccacttccacaacattcttatcacctgtgcacctgctgagggctgccttgggggctgtcccattggtccctggctagctccatagaaaagagcccgagtcagccggaagtggtggctcacgcctgtaatcccagcactttgggaggccaaggcgggcagatcacgaggtcaggagattgagaccatcctggttatggtgaaaccccatctctactaaaaatacaaaaaattacccaggcacgacggcacgcgcctgtagtcccagctactcgggaggctgaggcaggagaattgcttgaacctgggaggcggaggttgaagtgagccaagatcacgccattgcactccagcctgggtgacagagcgagactctatctcaaaaggaaaaaaaa

SEQ ID NO: 390190 - DNA, 413 bp, Homo sapiens
taaaatactaaaatatggaacagtacttatcataactttgagaacatattggagaagaacatccaggagattacttcctgttgagttttatattgtattttttcactgcctcatccccttgcatggtgttttactctttaagggactgtagaactgttcatatgttaaaagacatgacactgaaatgggtccctctcactgatcaactattagcggactgtgatggatttgactgtggaaaaatttacgtctactaatgtcttgcttcccttagcaattcctgagatgtttttaatgtgtccttctgaagtatcattaaaattatggggaggctgaggcgggtggatcatgaggtcaggagttcaagaccggcctggccaggggggtggagccccgtctctactaaaaataca

SEQ ID NO: 390191 - DNA, 502 bp, Homo sapiens
ccattccatctgctttacccacttatattacctgaaccctgagtgtcctagaacaggtgaaccctggcctaggtaatcacacctgctgaagaggctagtacctgaggcaggactataagaggggccagtgagccccgaggaaagaagggaggaagttttcatacccatagggaatctgaagcaggctgatttaattcaatctgagacagggcaagcgtgactagctttaaaagaagcccttgtgaaacacatcaccttgtcaactacagcactcgacagtgcggcacaacataaaatttccacaagcatttatgactggcatcagtttttcccatgtgctgacgtctgttgttgcttttagtattttttgttttgttttttagaaacagggtcatggagtgggtatggtcccagcactttgggaggctgaagtggggtgcgttgcttgagcccaggaatttgatttatacctttttttttttttttcctgagatggagtctc

SEQ ID NO: 390192 - DNA, 422 bp, Homo sapiens
aattgtgctgctgaggacacgtgtgtgtgagtctgtgtggatacatgtgttcgtttgtctcgggcagacacccaggagtggaattgccaagtcacgtgtaactcggtgtcatcttttgagaaactcgcaaactgttctccatagcagcggtaccgttttcacacccagcaacagtgaatgaggcccagcgtccccgtgtcctcaccagcactcgtgattgttgtctctgattctggcgtcctcatgggtgtgaggtggtgtctcttcgaggtgtctttttgtttgttttggtagagacagtgaatcgacccttttgctaagttggagctgtttcaaaatgggagaacctttagaacctagctagccaacaggactgggagggctgagtgacgtggtgcggcagttgcagccgagccctgtcc

SEQ ID NO: 390193 - DNA, 454 bp, Homo sapiens
ggatcacttgagtccaggaggtcgaggctgccgtgggctagcatcatgccactgcactgccccatgggcaacagagcgagacccctgtctctaaaacaaacaaaaagaagacaaaatttaatcatttattttattaacatacatatgggagttcaccagaaagactatccacattactagagatggaaactttcagctccttcccccaacctccagggaggggagtggggctagagactgggctccaaacactcttgaacaggaggttccgaaagtctggaatgatgaacgcattgatgtgctgggagggtggtgcacctggagaggacatggaagctctgttcccacctcctcctgctgtgccccgccccatgccttgccctatgcatcgcttccatttggttgatcctagttgtatcctttataataaactggaaaatgtaaataaaaaact

SEQ ID NO: 390194 - DNA, 264 bp, Homo sapiens
ttggagagcctgagagcagtgggcgggctggactcctccctgcccaggcaggtggcttgggactaaggtcccgtgcaaagaaccgcccagctcgccgtggctcagcccttcaaggctgctgccctgtgcctgggcaaggacacattaggatagggaaaaggcaggcccacgggtccactgggtcactgactggggcccgatgaggtttctggtttttgaaacatcacatcttagcaagatgtggtaacttggtctgaatcgcat

SEQ ID NO: 390195 - DNA, 565 bp, Homo sapiens
gtatctgggactacaggcgcctgccactatgcccagctaattttttttgtatttttagtagagacggagtttcaccgtgtcagccaggatggtctcgatctcctgacctcgtgatctacctgtctcagcctcccaaagtgctgggattacaggcatgagccaacgcgcccggccgatatagctagtttttaaaatgaaattacagtttaacattagctttttgatttactgtggtttttagggtactgtattagtagtgtcagggtcagtattatgttataaaaattgtgtcttagctttgcatttaatgcttgacttgcttgctactttttctctacgtgtgtgtctcattgcttttatccttttgctgtgagggttagagtttgtaaccaaacactaatgcagtcatactttataaggcatttattcaaagctttattgggcatcaataaataatggctacttaaattaattaaaatttaaaattcaattcctcagtaaccctagccacatttcaagtgctcaacagctacatgtgggtagtggttactatattggacagtgc

SEQ ID NO: 390196 - DNA, 762 bp, Homo sapiens
tgctggacttaaatgaccattaatgacccctccaaatgtaaattcctatgattgaatgaattttagctaattgttcctaacttattagtcataaccaaacagttcacagaaggactccagagtaaatacaattacaaatgaaaaacaaatgttctgatgggatccaaatatttgttgataacaagtgagatttcttgagaagcctgcagaatgttgttctcaataggagacataatttttaaatagtagaaattagagaagtaatacatttcagaatgtgtttaaacatattttctttaattcaatccatttattatattcaaaactcgtattcacaagcaaaaataactaagaactgattaagacaactaaaacaagcttttgataggtctttttcgaggaagcccaaaggtctcaagtttgatcgctgtttggaaaatatgagcgcaacactttaagacaaaaatttccatatgttggtcttattagaattcaaaactcattcatctgttccttcattcaagaaatacatagtggggagataaaagaaagacatagtgaaaatccactaagtgtaatatactgtagactttgcaatatgaataattctaaaaggaaaatgagatcatctatcatacatttaaacagtcttttaaaaaattcattttattacaaagtaataatcatccattaaataaaaaacttaaaaaatggcaatagtaaaaagaatacctataattataccatttaataaatatctac

SEQ ID NO: 390197 - DNA, 651 bp, Homo sapiens
agggctgggaggaagagcagagctgctcagagaaagaggcaaagatgttcagggtctaatcccgcttgccttcttggtggccttggaaccttgtgcgactgacttatcctctctacactcaggtttccccatctgcaaatgttgataagaacagaacctattcagtgagaggaagtaattcacaaaatgcagtgtccattgccgagcaaactcctccaacatgggagctacaaccgtgtgtgaacagctcaaagttctgagctgatgccacaaaaacaacactgttacccagacggaaaagcgtgaccaagatgacctggatatttgccttcttccacaaaacaatttgaggtcaattccatagcagcggttgtcaatcgaccctgttatcatgactgtccccataaggaaccctagtgtctccctcatctgtcctccctttggaagaaatactcaagaataagatttcattgaatagggtcgagctttggagggccacagactattgtaatcattaagatttgtttaagtgtcaaggaaccaattttggtcccattaggggtgatgctgcccctgttgggaatggcctagagatgcaagtccaacttgatcaaaactaagcaatggggacacagtatttaggaggtggca

SEQ ID NO: 390198 - DNA, 447 bp, Homo sapiens
tttatttctcagggctagctaggtgcctggaacttcccttcaaggaactcgggattttccttcatttccatgccctgttgcggggctggggggctacagtgccctaagaggaggcccctgccccgtctcaattggaggagcactggaggggactttattgtttaagtgttctgacagccagtagcactgaacaggtgtgcaccaggagagtgaaactgtctgaggaacagtagggcaggcactgtctactcgaaaacatacccaaacccccaaggctcagccttcgctagcagccactcagcagaaatgaaagcacaaatgtgtgtgggtagcaacaggagcatagtttgtgatggggaaaaaaattgaaaacagtctgaaggcagaagaggattgagtgagtgagcccttccatgtcctcaccataaaatgttgaggcgtctttga

SEQ ID NO: 390199 - DNA, 255 bp, Homo sapiens
cacacagttggctcccaggaccaagacaaaaccaacagaagccgtagagtgttcgtgcctttcacagcacctcctacaagcccctgaagcccgtgccatgccactctgttggtggtccacaaacacaggaaacgaagctctagagggcaggggtatgtgctcccctccatcatcccccagggtctggctttagcctggcccagggagccctcgcggcttcctgaacagacctcagtgcccttccccagctgtgtg

SEQ ID NO: 390200 - DNA, 538 bp, Homo sapiens
cccctttctcatggtgatgttgtaaagacaagataaaggacaaatgccagctccagcaccaggcacctcaggaaatggtgactcacttctagaacagagagcagagaaacttcatcgagggatgtcttgcctgaggctttcccttaggtcactatcctcctccactccccgacccacttctatcctacctcctactgcaggggccttggcccagtactgccccccgctggcacttgcggcacacacccctcccggaaagctaacgttttcaaaaaacttttatttcaggttcacaggtacacgtacaggtttgttacataagtaaactcgtgttacgggagtttgttgtacagattatttcatcacccaggtactaagtttagtacccaatactaatttttttctgctcttctctctcctcccagcctccaccctcaagtaggccccagcgtctgttattcccctctgtgcatccacgttttctcatcatttagctccaacttctaactcagaaaacgtggtatctggttttctgttc

SEQ ID NO: 390201 - DNA, 438 bp, Homo sapiens
ggatcacatggctacccctagttaacactggaagcttaaaagcaaaatctgacattttaaacctctgatgtggcaggaggctttgtctgccaggaataagcctgacaaaggtagtggttattggataggtagaaacaggagctgccataggtggactagaagcaaatagataaggacagggtatagttgaccttaatcaaaaggcaaaggtgaagtatacctcctaaaggctaggcaagtctccgagtggctgacttctatctgacctacgttttaaagaatgaagtagaggaatatgatatgggtaagacaaagcattgcagacacagcagactccaaagatgaagggaatttcttagtgaaatgagttccgcagggcacaatggaatggttttgagggaaggaagcagaaggaaaatgagcccaggtgagggcaaa

SEQ ID NO: 390202 - DNA, 406 bp, Homo sapiens
gctggaggccacggggtcctgaagaccccagtggttaaatacgaggccctgcctggtatttaacattctaatccgacctcagcccagtctgagggcagagagtgatctctaagctccaacggctcagaaacatgcaaaggcacctacccctgtgctcccccaggacatggagtggccacgagaggacaggtgcatccccggggaacgtggctccaggcctgtttccattgggaggaaatttctgaggctcctggtcctggcctctctgcagctcctacctcagccccttctccccaggggaggagtgtggggagcagcccttccctcacatctgggctctcccatgggacctgccccccaggagcagggctctgtgctcactcacagggagttctgggagctgcat

SEQ ID NO: 390203 - DNA, 578 bp, Homo sapiens
gcgagcatagaggacccggtgtttatcgatgccacgtggaaaaaggtaggatggttgcagcacttcttaagatccatcatgatattaagcagcgacacctggttcccaccacctcgtgaattcaaggcctcaaaatttcgagtcaggatgtatttgtagtatttcttctgcatggggcttagctccacccgaacgatgagctctgctgggctggcatccactcttcccacagaaagggtagagagagtgctccagggctgtcttaccccactggcggccatgggtccgtggttgctgcaaagctctgtgagtagccaagtagagtgttgccctgctcctggccctgcagggaacgattcagcccctgatgttcaccctcaagagctaggcctgctggccagcctcacacctccctctgtgcacatctgtcttcctgggaggatggtcctgcccttgagcttggggtgaggtccctggggtattctgaacactggttgctattcagatgaagaacttggaatgctggggggttatgagagtggtatggaattattcagcaagtaggtggctgctgcgct

SEQ ID NO: 390204 - DNA, 361 bp, Homo sapiens
aacagacgagggatcagatgggggaaaggtcatgtacactgtttaataatacctataataacaataaagcaatggtaaactacatatgtgattttaatgtcccattatcatgtttctgaagtgaagaaattcagtgagaaaaaaagatgggacatttagaaacagggaatcagcactccctaataacaaaatataagctagcatagcaaactagcaagcctaaaattactaaagaaacatatttgtaaacatcagaagaaaaaaagaaactttaaaatgtccactggcttcaagatgaaatataaactaacacttccaccaaagacagaacgtgtacaccctgagacctgcttgataggag

SEQ ID NO: 390205 - DNA, 350 bp, Homo sapiens
acggatttgaattccagcaattccacttatttactgtgaccttgggcaagttacctctcctagccatatttttctttttttaaagttattgattttttaaaattaatgtattattaggaatgatacagacttttgttgttagtcctaataatttgtcttgcattctcaatgtagataatcatataatttataattgaccaacaaggacagtgatcttcctttataattattgtttctctaaattctttcccttctttccgtaatcgttttttgaacattgcattgaccattacctacattttactgttgattagaagccataaaaggcatccttttcttgtctctgaccc

SEQ ID NO: 390206 - DNA, 334 bp, Homo sapiens
atcggttcaggataatggccagtgactagaaagactaaataaagcatgattagagggttagaactttcagcttcacctcaccctcaacctctgggaaggaaagaggagctagaaatggagttgatcatcgatggccaatgatttgattaattatgtctacacataaaagccaaaaccatggggcttgaagaacttctgggttagtgatggcatccatgtgccagcagggtggcataccctaactccacaggacagaagcttctgtgctcaggccccttctgtacctcaccctatatcttcatctggactaggtataactctgggtaagtaggga

SEQ ID NO: 390207 - DNA, 734 bp, Homo sapiens
tgtgctggtaatgtaacatgcacaaaggatttcaaataatagtgtgaaaaaaagtaaaaattttctcatttgtaattttcataatgattacatgtttaaatactaatactgtgtatagggttaaataaaacatatttaaattaatttcacctggttgtatctaagtgtccatcagccaattaacggataaagaaaatatggtacatacacacaatggagtactattcagccacaaaaaggaatgagatcctgtcatctgcaacaatatggatggaactggaggtcattatattaagtgaaataagccacacacagaaagacaaactttgtatgttctcatttgtgggaggtaaaaatgaagacaattgatctcatggagatagagtggaaagatggttatcagaacctaggaagggtagtgagtggcaggggtgtgggagtggagatggttaatgggtacaaaaaaaaaaagaaacaaacaacaacaaaaaaaaattgtgtggggcggcttcgggccacaaaaaaaggtttctaaacacattccggtggggccggggccccaataggtacggcaccttggcccaagagcggggccaagaaaatcgggcaagaactaggcgtggttccccacaaaaaaaagcgccgggggaaccgggcgcgtttggacaatccaaggggtcggggcatacccggctccccaggggccacgaatgaatagccggcggggcggggca

SEQ ID NO: 390208 - DNA, 423 bp, Homo sapiens
atcacagaatttttgattgtctgtggcctccatgctttcaggctacacccttgtttatactgacaacaaggtggaatggctgcttaaggagggtaaaactaggacaggggcagttcaaactaatagatgttttaacctttccacctgttggatttctggtaatcaccaaatgaggagggggtttttccagtcttgcatgagcttcttgtataagggttttgtttttagggcataagaatctatccatagacgacagtatctgactaatcttaaaatttcctaagttcttgtttagtccctggcagaggaaaggatatgatgcctttaatccgttcaagctcaattagccatttacctttgctaattaaatgacttgttctaatatttgactaaataaatttgaagactccataaaaaaaaaaa

SEQ ID NO: 390209 - DNA, 504 bp, Homo sapiens
ctgcctggcctccctatctccactctgtccacaaatatcatgtctgccatgactatatagctaacattttgatagcacattcatcggttctcatatcgccagaagatggttatcaaatgagaaaactaaagctgtgtaaacaaacgaacctgtttgagtgaacaaatacttattgagacacactatatatcaagctctgtgtaaggcatgaatcatgcatgatctctggaacagagagctcacatcctggcggaaagacacataaacagctgaagttaacaaaatgtgtcaatgacaaaacagagtaatgaaagggctacaagaggaggcaagagaagtgtacccagctcctggaggtgacgtggggctgagtttgaaggatgatgtgtatcagccagacacagaagcagagtgaagggtagtctctggagcaccagaaagagtgctcaagttcaaaggaagacaactgggtctcattcaattcatgttgcctgttccttacat

SEQ ID NO: 390210 - DNA, 428 bp, Homo sapiens
gaacccccatttataaaaccatcacatctcataagacttattcactatcatgagaccagcatgggaatgatccatccccaagatttaattacttcccactgggtccctcccatgacatgtggggactgtaacaattcaaggtgagatttgggtcaggatacagccaaactatatcgctgggttttggccaagggggaaatttcatgtcatttactccatggctgggcacagccaggcaggacactggacacgctgtagcagccacagaggtcacgctcaggtggtccttgaacagcgctcttcccacttgagggcgtccaggtgaaggtggcaccagaggcatctctcaggccggtcagtgtgcacgtgaggttcgcttctgaacctaagagcaggtcctcgagggccgttcggtgcagcgacagtcg

SEQ ID NO: 390211 - DNA, 279 bp, Homo sapiens
ccaccttggcgtcccagagtgctgggattacaggcttgagccactgcgccttaccccttttgttttttttaacagctgtattgagctataattcacataccatacaatccagccatttaaactatacaattaactgtttttcagtatattctcaggattgtgcaaccatcaccgaaatctcttagtagatccttttgtcttctgtaaagaaaccctatacccatcagccctcaatcctcagacccctccactgctctccctgtcacgcctaccctagcc

SEQ ID NO: 390212 - DNA, 253 bp, Homo sapiens
tctaggcttgcccctggccatatgacacctggcagctgtcccaggtccctgagccgtgtgcctcctgtacagggagggtgacaatattatctgatatatcttttaagagcaggttcaggaaacccagagtagtagctgcaaaaacaagataagatggttgatagttttttgtgtaaattaagtccagactttagtatcccgggcaaagtggagcagctccacaggcatcagggtccaggccctgcatgttcct

SEQ ID NO: 390213 - DNA, 539 bp, Homo sapiens
tgtcctcttggggctattcagagatgttcatggtgatgaaacgagctggcctggaatggcagttcccaggtagcagagcctgggcttgaggaaggtggaacgtgggtgtggcaaggagctggcaggtgcaaatgtcaggccagcaatgcagtccagcctgcacggacgtgcgtcacctaggaagttgtgacctggctgcagtttccacttcaggctacagagtgcggtggcgccagcacagagctctgctcaacgtccctctgtgctttcacgatgctgatggattatgaagatgaggaagcggatgcatagcaagtttaaatagcttgcagaaggacacacagtttgcaagtgaaggagctcaaattcaaagactggcagtctgcatccagagttgatcatcttaaataccatgctgaaccggttgctctcaaagtctaaacagtattttttacaataagatatccttttgtaggtcaacgaatagtttctaattctttttaaaataaaatacaatgaactgaatacaaggtgggggg

SEQ ID NO: 390214 - DNA, 329 bp, Homo sapiens
  misc_feature (43)..(43): n is a, c, g, or t
ccttgtgaagaaggtgcttgtttccccttcaccttccaccatngattctacatttcctgaggcctccccacactgtggaactatgaggaagcggatgcatagcaagtttaaatagcttgcagaaggacacacagtttgcaagtgaaggagctcaaattcaaagactggcagtctgcatccagagttgatcatcttaaataccatgctgaaccggttgctctcaaagtctaaacagtattttttacaataagatatccttttgtaggtcaacgaatagtttctaattctttttaaaataaaatacaatgaactgaatacaaggtgggggg

SEQ ID NO: 390215 - DNA, 300 bp, Homo sapiens
cgtactcctctcccatcatactatagaagccgacggaggggctatgggagacaatgaggaagcggatgcatagcaagtttaaatagcttgcagaaggacacacagtttgcaagtgaaggagctcaaattcaaagactggcagtctgcatccagagttgatcatcttaaataccatgctgaaccggttgctctcaaagtctaaacagtattttttacaataagatatccttttgtaggtcaacgaatagtttctaattctttttaaaataaaatacaatgaactgaatacaaggtgggggg

SEQ ID NO: 390216 - DNA, 750 bp, Homo sapiens
tgtcctcttggggctattcagagatgttcatggtgatgaaacgagctggcctggaatggcagttcccaggtagcagagcctgggcttgaggaaggtggaacgtgggtgtggcaaggagctggcaggtgcaaatgtcaggccagcaatgcagtccagcctgcacggacgtgcgtcacctaggaagttgtgacctggctgcagtttccacttcaggtgcgacagaagggtgaactccacctcacctcctggctacagagtgcggtggcgccagcacagagctctgctcaacgtccctctgtgctttcacgatgctgatggattatgaagtccacagacagcaagggcagtatcactgcagtggcagtcgcagatggactttcagtcgcctctaggagctccaccccacagaaacacagacagcagccagtggaaatgttcagctgagtgtgaggtgcctgcactgtgggcccaagccaggagccctgcctggtgaagagtagcagatgaggaagcggatgcatagcaagtttaaatagcttgcagaaggacacacagtttgcaagtgaaggagctcaaattcaaagactggcagtctgcatccagagttgatcatcttaaataccatgctgaaccggttgctctcaaagtctaaacagtattttttacaataagatatccttttgtaggtcaacgaatagtttctaattctttttaaaataaaatacaatgaactgaatacaaggtgggggg

SEQ ID NO: 390217 - DNA, 336 bp, Homo sapiens
gggagcccctcaggaccccatttagccacctgggaattgggtagtggcgtgcactgtgcagaggagggtgaaggttggaggagatgacgggcgggcctgcaatgcgctgcgtagggagcctgggcggtgccccacacactcgcccgctagctgcagggcttcaggaaagaggagcacatcgggacttggattcttcccacaggagggcgggttacatccccgtcagagggttgccgcgagggcagataaaatcagacatgaggattcttgccctctggtgggaacccagaaggaggtcagggagggaaggtctcccttcctcttgttgcgggtggt

SEQ ID NO: 390218 - DNA, 1362 bp, Homo sapiens
gagcgaggaccagatggaatttttgtttaatactgtatctgaaattgaggatgggatagataggaaatgacctatcatttcatgaggagatgacttttctgtgataatgggacagagatgagcttagatgaatgaatatatattttagcacttacctttttccataaaacacaaatagacttggtgcaaaattaccagtctcactccatggtatttctgatgagatcggtaaataatagagagagacatacttctttaggagctagctgactttaacatatgctggagtacaattgacttacaactatttggcgttagaaatgatttttctagggcttggtgggggaaaaatactcgtgaaatacctgccttgacttaaacttcaacatattttaaagtcattttattatcccacaactcagaatgtcttcaattaaaggtaagaaaataaggtgatgggctacagtggcttaatcaggtgttcagttaatgaagtagaagaaggatacagattctaataattcacagttgtagaggttctagactgttcttagtatgaagtcctggcagtgtatgtggcagagtgaataatgtttcacgacctggtgagtcatgtgaggactgtgagtaacttttatcttctgtgtgtcccacatagcatataacagtactatgctagtgatttgcttgacagttattgaatgaatgctaagtttcaaatatttatttgatagtcacttgattaccaagtaatcaaataattacttatagtgttttagggagttttcagaagatatttgtgattaaataaatgattatatatgtatattagcatactgtatgcatttgtcagttgggaaagaggggaatatggagaagtggggaactgcattcagtttttattttataggcaactaatatggtcctttggttttattttaaaatgaaactgagccttgagcattttgagctttcatgtcaaatgccttgaatggaagagtaggaatttcatgtaagtagcttacatctgccctgtatgttggagaatgtgattagatatacttgcttttctgcccaaggcactatttttgtatttatattgctttttgcaggtttacttctgttaacaggggtccgggagaaattaaggcttaaaatatcaatacttctcatttttccacagccttccaaggcttccatctttgtgccagtgtgtggctctgggtgccatctaaccgcaaaagcagcagttgggtttggatgagctgtgtgacatttggcctacacgtaggtctactcaccaccctggtcagggaacctggaacaatcctaaaactcacctactctaatgcaggccatatt

SEQ ID NO: 390219 - DNA, 286 bp, Homo sapiens
aaacatcaggagaggagttatctttggggaagggggaagtgcataaggacttctcttctgactcatgggccagccctacaagagtaaatccctctactctccttacctggaatcctgttacctgaggaaaatgtatacctcgactccttttcagtattaccagggaacagacaaatttaactgagcatgtaagtcctgggcagaaactcggagtgtctatgaaagtcccttcactctggtgattagatcctgactgtctgtgtcacttaaaacaagaagttgtcca

SEQ ID NO: 390220 - DNA, 484 bp, Homo sapiens
tagttcctccagtgactatttttgttgcccttgggaaaataataaacttcagtttcctccaccaagtacagatgaggaaaatgattcatgaggaactagcccaagatcccacagccattaagagatacagctgatgtttcagtcaagacctgctacttagtcctcatctattaaatggagaccgtgacttccacgttcccttaataagcacaagtcttcttttccttatatccattcagctaagcaaaaggggggatgacaccaatttaacaagatctttgtgtgaattcagttgaaaattatgtttgaaagttctccgtaaattatgttacataattatattaatcatgtacacacacagacttagccactcttccatcactccatcctcctcattgcagccaatatatcttttcctagacagcatgatatttcatttaagacttgtcttaaatgaaagttctttcagagagagaaaaaaact

SEQ ID NO: 390221 - DNA, 274 bp, Homo sapiens
cttttggagggtggaaggtctagaggatcaggaaaaataactaatgggtactaggcttaatacctgggtgatgaaataatctgtgcaacaaacccttgtgacacaagtttatctatgtaacaaccctgtacttgtagccctgaacctaaaagttttttttaaaaaaaaaagaaagaaagaaaatacagataagtctgagcccaaagtatttacccaacaatggtaaagtattttaataaattactttattactggtttcttgggtatccttcta

SEQ ID NO: 390222 - DNA, 414 bp, Homo sapiens
agatgctgtcttaaccttaaaattttaaaatattccagatacttagcttaataccaaattgatttgtaattgctaataaaatgtagatttagaggaccattaagaatgtgtcatgctcgctttggcagctcacctactaaaattggaaccatacggagattagcatggcccctgtgcaaggatgacataagaagcattccatttaaaaattaaaaaagtaaagaatgtatcggagtgttagtttcttcagacctctttttattctccaatccctttttaagtattttataatatcttaatggtaactatagatgaatattagtaattaccaggcaatgttttgggtataaatgaatgaaattatgaggtaattgtatttttgtaacctgttagttaaatgagcccaaactaata

SEQ ID NO: 390223 - DNA, 501 bp, Homo sapiens
tagagtagtactcactgtgattaagggtacattgtttcagtaactgatcccttgaggcagtgaattgcccagtcagtgcaggagttttaagggtccaggtctaaaggtggaattgcatcttttggctctgtttgaagctccttcttgtgtgcctgcacaggagtgcagtgggtacatacctgtgagcacatgtaccctatttcttggaatgacattcttgcttttaattttgggctgactagaaatttttgtctgtgatgccagtggtgggtagataggtaaggatgggcacagtttagccaacatggtgaaactctgtctctactacaaataccaaaatcagctgggcatgttggcaggcacctgtaatccctgctactcaggaggctgaagcaggagaatcgcatgaacctgggaggcagaggttatagtgagccgagatggcactgctgcactccagcctgggcaacagagtgagattccatctcaaaaaaataaaaa

SEQ ID NO: 390224 - DNA, 287 bp, Homo sapiens
ggcacaatgcgcctttccagaacacagcagcgcacagccaggcctggggcagagggatcactcaaacagcaccagaggctgcattcctacttttcttccgtcaacaagtccattttcattgttagtttctccttcaacacaaacttaaaaacaaatggctgaacacgcaggaacaaggaaaacctgactgaagaatgagacgttaaaacttaagggccttaggtcctggcacggtggctcacgcctggaatcccagcattttgggaggcagaggtgggtcatttgag

SEQ ID NO: 390225 - DNA, 265 bp, Homo sapiens
gttttttgacaaaaataacaaagcttcagttggcactgccattccttgtctgccaaggttaacacagagcccaaggagaaaactgaccagctcaaactgattcacccacagcagacctcaaatgaaacttcaaatttcaggaacttgtcctctgccaaggtggaagtctcctccaaaaggaatcctctttcctaacaattacttgtgactcaacagaagtgggattgttttaagggtgcagtggctcacacctgtaattccagca

SEQ ID NO: 390226 - DNA, 342 bp, Homo sapiens
taccccttggttcagctggtcatggcaagtgagtcctccctatcacccacttccgcggtggtgggacgcctggggggcatggatggggcctgcgtcctaggagaccttggctccagctgctcgaggccactttgtctcttctgcatgtcgcagaagcgtctgtacctcctggggttggctttcctgtgagcatttgggctccctctgcctgggtggcctgttgtctggagggagtcttcagtccctcttagtgcagcagccaagggtgtctcttctcactccctgagccttctgattcctgtatcaggggaagttaaaaagtgttgtaaatggacttggacc

SEQ ID NO: 390227 - DNA, 369 bp, Homo sapiens
tgagccactgcacccggccaataagggtgattttaaaagacaagagcataatgtatttgaaaagaatgtgtttggagacatataaacctggctttgaactctgaacctatcacttatcagctgtgtggtttagcttcaggtatctctcttagacttctgcttccttgagacagaggttgtggctgagtaatctgtgagggagataatattattaccctagttttatagatgagcaaactgaggcttagcaaagttaagttggtaatagagaactcaatttgaactcatggagatttatcccctggccttttctcttaaccattgaactgtgctatctctaagaagtcatagaacaagcaactagagtca

SEQ ID NO: 390228 - DNA, 770 bp, Homo sapiens
acattttctaattggttgttactgatgccatggatgtttgtatattaatcttgtctccagcgtccctgccaaaccctcttatttcttgtaattgttcatagtttctcatggattatctatgtagacaatcttatcatttgcaaataatgccacatattcccccttcatttctaattctgattttcttactcctttttcttgctttattacatcagcaaggtatctcatacaataatgaatagagtggtgagagagaagacatatttatctagttgctgattttaaaggaaatgttcctaaagtttcttgtaggttcttaggagaaacttccttctgtttctgttggctaggtattttattttatttttaaattgtgaatgggggttaaatttgttaaatgatttttctgcatctattgagatgattatatggtttttccttcctaatttgccaatgtggggaattacattaagattttctaatgttgactcttacttgagcttctgggataaaacctactgggtcatctcacacacattccgtatatttattgtgtgataaacatgatattttgatagatataatctcaaatatgtatattaaagaaatactatatatttgtgcacacactatactgctggaatttttgctaattttttttttcagattttttgcattgatactttaactgagattgaccaatacttgcctttttttgtattgtcttagtgtttttctacaatgtaggtttagactgaactcataaaaat

SEQ ID NO: 390229 - DNA, 329 bp, Homo sapiens
gtagctaagccagcaggaggcggtgctgggattaaaacccaggaccatcagctggggccagtctgagctcttcaagctcagagctgaactatctcgttcactcagccttcccggggctcccccacccccatggaattcctcagaagccccaaacacaccaacgacctccaggaggtgtaaacccagagtcactggccaccatcctgagagtcacgatgtggctatgcagggggcagggacaaggcaagccaggatgccacgctggccgacttccctgtcaaggcccgagtccccgtcccagccacgctccgggcgtccagtgcagatgc

SEQ ID NO: 390230 - DNA, 159 bp, Homo sapiens
tatttatttcatcagttggcaaacataactatacatccctcagtgcatttgctgtggccctccctgacagctcttaggataacctttcctccattcttcatcttgattgttttgtgatcttcactccgtgttttctgcttttcctctaatctgtgtcca

SEQ ID NO: 390231 - DNA, 270 bp, Homo sapiens
agacctaacatgttctaaacggtaaaccagaagacaatagttaatttagttacacgaccataataaccacaattctgaaagttagtttcccaatgatcactcacataagtaactatatcctctagatcaaaagcattaaggacctgctcataaggcattcttaacctttaggaatttcacttcattctatatagaagttattcctccacaatgtacagaaaggaggcaacagcaacatttttttttctgacagaaaaactattgtgtgga

SEQ ID NO: 390232 - DNA, 669 bp, Homo sapiens
ctgcagctgggcctggaggcagtggctctacagcagcagtgagagccgagctgtggcagacacatgctcttcccctgactcacggctgcccagttccctccagcgaggctgctgacctatttttctattaggaacaaccagccaatgtgataatgaggaaaatgtattctggcccctatgaagtttagtgaagcccgaatgaagtggaggaggccacggagatgcacgaggaagagcattccaggcagagggaacagcgaggacaaaagcccccgggcaggaatgggtgtgcaagcctgagatccaacatggcggagagcaagccggaagtgctgcgcggggatcctaagggagcactgaacaggacaagctcagttttgtccctcaaacctccacaatcagctattttacataaggaaagtgggtggtgattaacctcagagtctccagggacagactatccaggactgtgcctgaaatagaagaggaattaacatcatacagaactgaatacggtgactgaggggagtttgtgtctccccttttaggaaagaagatgagaataagtatgaaggagagtcatgtactgtacattaagcaaaagcatgatgctgttatttgaaatgttaattagaggtgcccactaaaaactgctcagcaattttcttg

SEQ ID NO: 390233 - DNA, 757 bp, Homo sapiens
ctgcagctgggcctggaggcagtggctctacagcagcagtgagagccgagctgtggcagacacatgctcttcccctgactcacggctgcccagttccctccagcgaggctgctgacctatttttctattaggaacaaccagccaatgtgataatgaggaaaatgtattctggcccctatgaagtttagtgaagcccgaatgaagtggaggaggccacggagatgcacgaggaagagcattccaggcagagggaacagcgaggacaaaagcccccgggcaggaatgggtgtgcaagcctgagatccaacatggcggagagcaagccggaagtgctgcgcggggatcctaagggagcactgaacaggacaagctcagttttgtccctcaaacctccacaatcagctattttacataaggaaagtgggtggtgattaacctcagagtctccagggacagactatccaggactgtgcctgaaatagaagaggaattaacatcatacagaactgaatacggtgactgaggggagtttgtgtctccccttttaggaaagaagatgagaataagtatgaaggagagtcatgtactgtacattaagcaaaagcatgatgctgttatttgaaatgttaattagaggtgcccactaaaaactgctcagcaattttcttggagacctcagtgctcatgttattctttcctctatcttatgttttcctctctcctgcccttttcagaaacagtctacagcagaagccat

SEQ ID NO: 390234 - DNA, 1124 bp, Homo sapiens
atgctgggtaacaaattaccacaggtttactggtttataacagcataattttattatctcacaatttcttggggttaagagtttcagcatggcttaactgggtctcacaaggctgcagtgaagtcagctgaactgcattgtcatctggagctcacagttctcttctaaattaatcagattgttgataaaacttagttccttgaagctgtagaactgaggtcctcagctacttagggctgctcttttatataagcagtgtaacgtgacatgcctttttaaggtcagcagaacttctgactagaatctgtttcagagaaggccagaaagagttcacttggttaggtcagagtcacctgggatagtctcccttttgattaagtcagagtcaactaaataggcaccttaattgcatctgcaaaatcctttcacttttgccatattctcttactaaatgtaacaggcgttgtccacacaaaggtatggatatggggcttggaaaggatttcaggaaccatcttagaattctgcctactactaactccattctacaagtctcaatatctagcattttagttattcactaactgcaaagttttttatttcattatcattactactttgatccatagatactatttggaactataatttccaaacatgaatatttaagttttcctttattgttgatttttaacataattgaattgtgatcagatgatatattctctatatgatttaaattctttgaaatgtgttaacagttgctttatgacataataagtggctggtttttataaattttaggatgcttgaaaagagttctacagttatttatgttcattaatcattttagtcatgttcattaattttcaagtcttcagtatccttagtgatgatttttttgtttttggtatatatctcttgattactaagagaattgtgttaaaatgtagctagcatgattttagatgtgtttgtgtgattctttcaatttctctctttttctattttgtattgggatacaaatgtataattgttatattttccaggttaattgaaagaagctttatcattacaaaattatctttatttccactaataaattttgccttaaaattaaaaaa

SEQ ID NO: 390235 - DNA, 513 bp, Homo sapiens
cactcagaaacaaagtgaaatccatgtctagttctcacttataagtgggagctagacaatggatacagatagacgtaaagatggaaatgggggaagggtgagggtgggaggagagtgagggatgaaaaattacctattctgtacagtgacattattagggtggtgggtacactaaaagccgagacttcaccactatacaatatgcccatctaacaaaactgcacttgtacccactaaatctataaaaagaaaataaggtggaaaacagaatggatgatctaaggtaccttcagtcatattgctggttttatccattgggccacatgtgtctaaggctagtctgggtttatgtggtggcagaggagtttccagcaacaagagaacaaatcccattgtgcagacagacgcctttcaagtctctgcttgtgtctcatttgctactaccattagtcaaggcaagtctcatgggcagcccagagtttatgtaggggaggataacacgtcgcgagaatt

SEQ ID NO: 390236 - DNA, 442 bp, Homo sapiens
gcctgtaatcccagctacttgggaggctgaggcagaagaattgcttgaacctaggaggcggaggttgcggtggggccgagatcacactactgcactccagcctggacaacaagagcgaaacttcgtctcaaaaaacaaaacaaaacaaaacaatgttcaacctcactcacagaagacctaccatttaaaaccatactaaaatactatttcttagatatcagattggaaaaagtcccaaagcttgacaatacactctcttagctaggctttggggatgaaggcaacctctgtattaccagcgatgggactgtaaactagaatgatgtctacggaagaaaatgtggaaatatctaccaatatagatctctattactctatattaatacaggccaggtgtggtggctcatgcctataatcccaacactctggaaggccaaggagg

SEQ ID NO: 390237 - DNA, 474 bp, Homo sapiens
tggtcaagactgggaaacaatggttaaactcgtttactcttcatgaacgagtctcctgtgatgtccaaatctaacaggctcctgataccaactcagggaaatcagaaagcaagcttgggaaacaagggataccatgtgacccagatcagcttagttcaggggtttcacgtagcaagtatgtgtgatgaagtacagcaaggacttgatcaaacaatttatcaaaatccatggagctaggccaggcacagtgctcatgcctgtaatctcagcactttgggaggccaaggcaggaggatccctcaagcccaggagttcaagaccagccagcataacacagcaagaccccatctctacaaaataaataaataaataaaattagctaggtgtggtggcatccacctattccagctactagggaggctgaggtggaaggatcacttgagcccaggaggttgagatagcaatgagccgtga

SEQ ID NO: 390238 - DNA, 220 bp, Homo sapiens
tacagcacccagaggaaagactgcccctacagataagggtggataaggaagggttcctgtgaagtaagagtgttgaccgggaccttgctggagcagtgctggaaggacatccaggaggtccacagggtccctgagatcccttgggagaagacatgcaaaatcaaatgccctcagttattctgctatttttcaaatagtaaatgctacctggtgggcacct

SEQ ID NO: 390239 - DNA, 280 bp, Homo sapiens
aattgcttatatttagctatgaaaccaccttcagcaactgcatttttttccctgatccaagtaatataaaattatcttgtttaaatttttaaatttagtttgtataatgattacttacaaactgatagcagcccaaaaatgtgtggaagagcagagaactataatgatataaccatccagaaagtagacaatacagatttaatggcaattttcatactctttaggcagattcttttagtttctcgggaatgaaatataagttacttgctcatgctactgg

SEQ ID NO: 390240 - DNA, 540 bp, Homo sapiens
tgagatggagttccactcttgttgcccaggctggagtgcaatggcatgatcttagttcactgcaacctctgccttttgggttcaagcgattctcctgcccctgcctctcgagtagctgggattataggtgcctaccaccatgcccggttaatttttgtaattttagtagagacagggtttcaccatgttgtccaggctggtcttgaactcctgacctcaggtgatctgcccacctcagcctcgcaaactgctgggattacaggcgtaagccaccacacctggcctcaatttcttttctgtacaaggtgggtgttgggctagttaagatcccctctagctttaatgttttctattctatgcactgaaatttaaccaactaaaggcagcaaactacatggacatgagatgatccctagttttcctacttggtcacctggcacgctctagtaggattagcctccccatgaaggagatatgagctgtatctccaagactggacagcaaaatgtcaagaactgaaccaagtcacgggcaacagtt

SEQ ID NO: 390241 - DNA, 385 bp, Homo sapiens
cgctctagaggattaccgcttctcacccaccccatctacccaggcaagcacctgcccgtcgggccctcaccctggagccaacaatgccatcccttcctactactgacgccaggccgcctgccttgtaggaagtagaacaaagtgttgagcacttggggctccaggtgctgctgactcgaggtaagagcacagctatcatcagaccaagtactagaaaagagcctcgtagggtgcagtggcttactcctgtaatcccagcactttgggaggcagaggcgggaggattacttgagctaaggagtacgagatcagcttgggcaatatagtgagaccctgtctctaccaaaaaatcacaaattaaccggggtgggtggagagcgggtgt

SEQ ID NO: 390242 - DNA, 501 bp, Homo sapiens
tacaagagaaaggcagagggacatttgagacagagaggaggaggccacatgcagatggaggcagaggctggagttatgctgccacaagccaccgaatgcctagcgactccagaaactgggacggtcaaggactgattctctctagagcctttggaggaagcgtgaccctgccgacaccttaatttctaacttctggccttgagaaccaggagagaatacacttctgctgttttaagtttgtggtagtttgtcgtggcaaatttaggatgcagatacaggtactaagagcaaaaagccaactgctgtcagggactggcgggtatagcacctgggtcaaacacctggatgggccccgctggaagggcagctgtcctccactccagtccacagcggacaggcagaatgtgggcccagagacaccagatcttctgatttctcatgagaaattgaacatctgagcttttaaataaaatctcctgatctttaaactttcacaactaa

SEQ ID NO: 390243 - DNA, 509 bp, Homo sapiens
atcccttcgattcctattgagaaaggggggggagggggggggggacttaaacaaacaaaacacctgtgtcatctaccctagaagtctgaatgtaggcagaccactaactggagaatgacgaccatcaactttcacctgtacatgtcacacagagcaaggccacagaggttctcacgggacaacccacgaagggaaatgctgaatgtcaactcagcttagctaatgaggaactgacctttggggaaggatccggcgctgccagtgattatgactggcttaacacttccctctgccacgtggcttgcaaggttcccccatggctggtgtcttcctcaggggctgtggcagccaaacgtgtttaatgaacccagcaaagtgataaactatgtttgtgttaatacctttgattccaccccctcactggagtgttggtatgctaagcatccttttgatgtactacaagtccttaataagaacaatcaaataaacaactggcctcgttggcctca

SEQ ID NO: 390244 - DNA, 616 bp, Homo sapiens
gctataggaactgggctctgggcaaagcatgctcgctgtgacccctcttgcaagcattttcctgtttaagctgtggaagcccatgtgaagtaaacactgaggtcttttaaggccgaacgcccttgccacgccatcggcatcgaaggatgatatgaaaacaaacaaaacacctgtgtcatctaccctagaagtctgaatgtaggcagaccactaactggagaatgacgaccatcaactttcacctgtacatgtcacacagagcaaggccacagaggttctcacgggacaacccacgaagggaaatgctgaatgtcaactcagcttagctaatgaggaactgacctttggggaaggatccggcgctgccagtgattatgactggcttaacacttccctctgccacgtggcttgcaaggttcccccatggctggtgtcttcctcaggggctgtggcagccaaacgtgtttaatgaacccagcaaagtgataaactatgtttgtgttaatacctttgattccaccccctcactggagtgttggtatgctaagcatccttttgatgtactacaagtccttaataagaacaatcaaataaacaactggcctcgttggcctca

SEQ ID NO: 390245 - DNA, 516 bp, Homo sapiens
atttgattttctgagagatttacagctgacgacgtagttgagggaggaggtaactaaacaaacaaaacacctgtgtcatctaccctagaagtctgaatgtaggcagaccactaactggagaatgacgaccatcaactttcacctgtacatgtcacacagagcaaggccacagaggttctcacgggacaacccacgaagggaaatgctgaatgtcaactcagcttagctaatgaggaactgacctttggggaaggatccggcgctgccagtgattatgactggcttaacacttccctctgccacgtggcttgcaaggttcccccatggctggtgtcttcctcaggggctgtggcagccaaacgtgtttaatgaacccagcaaagtgataaactatgtttgtgttaatacctttgattccaccccctcactggagtgttggtatgctaagcatccttttgatgtactacaagtccttaataagaacaatcaaataaacaactggcctcgttggcctca

SEQ ID NO: 390246 - DNA, 451 bp, Homo sapiens
cagtagagccacaggagaagacactgggttaggcacgtggactcattgtctggagtctacttgccatcagagtttattacctccttcagcagttactttggaaaggtttacaatctcccaatatcaacatgagttttattagaatcctttaaatatttaatcccttattaaatctttaaatatcccagctgcccccaaaaagcagatgctgttctgcccaggtcattgactgtgtgagcctccatatttatttgaaactctccatcttcgagtcaatggaaaggaaagagtattagctctgaattttcatatcgcattcaatcttttaagtcttatatgctctcaggacttaaatctcaacaaatggactttcaatagaaatccttgtagtcactattaaaaaaccagtttgtgagtttttatttccactcaaagcatgacaaaaaggtac

SEQ ID NO: 390247 - DNA, 308 bp, Homo sapiens
atttaaggagccagatagacgctactccagggcaggcacttacctataccctttctcttcctccatctggttcccatggaggcagctgccgcatttggagccttggcccaggctagccccgggagcctcacacagctggggagaggccaaggatctcgcagtcactagccaggctcaggatcaggggcctttccttggctgggcactggggctgggtttggaggagacattgatggttcaagcttccttgggtggggaggacagtaagcacagagtgaagtgctggtgggggcccccctttgccaggc

SEQ ID NO: 390248 - DNA, 324 bp, Homo sapiens
acagcattaaacataatgaagttgttcaaattataatcatgaatatttttacatgttcttttctaaactaggtaaaaattcagtgcattttaagatgacataaatatatgaaaaaagggtctgtggtttctaagttttgctaaccatccttagcagttattctcagtatttctaagataagcatggctagaagtggggttagagccccacatcaaggagttaaactgtgcccatgtggctaatggtattctaggatcaaatttaaagggataagaaaggcttatcatactacttttaattttcatgcttagttctttatatttg

SEQ ID NO: 390249 - DNA, 282 bp, Homo sapiens
  misc_feature (66)..(66): n is a, c, g, or t
ggtcacccatatcatggaaggtaatttgctttattcacagtctactggctaagtgataatgtcatnctgaaagagtcacagagacatctagacatctaggtgtcagatcaaatatgtgggtaccgtgacctagccaagttggcaataaaattaaccatcacactgatccgaaaagtttgggtgccactgactttaacgttctcctgcatataggcaagaattaaaacacacacacaacaaaagtttatttttactctgaaccacttgagggcaccatgaacg

SEQ ID NO: 390250 - DNA, 313 bp, Homo sapiens
tcagcagggagagctttccttctgaaaagtgcccttgaaattggaacttgtaactttgcttgatgggttgtgaattcctaggacatgagctccactcatatacgttgaaaactatcattgaatacatccagttcattctgttgccctgttcagggaggaaaactatgttcaggaaagttaaatcggctgtttcattaaatttcctctgaactgtctgaggtagaggggttggtctttctattttattgctgggaaaacaggctcggaaaagtgaagtaacttgcccagttctcacagccagcaggtgaaaggg

SEQ ID NO: 390251 - DNA, 506 bp, Homo sapiens
aattaatataaatctcaagagccacacatggctaggagctctggtacagacagcgcagctccagtaccagggagcaccgctctcctgagaaagctacatgtcttggctctccagtcgaatttatgttcactttggggttatgcccttggtttccttcaagggaaatcttaagaaaaccagacagtggctgtcacgggaatgtagatggggattgtctactctatccttttttattgtttaatctcaaatcctgtgtggaaatttcttttacagcttcttttaaagaattaacatattttcttatcattagcaacagaattatccaaataaccacatttccctttcacaatggctgccaggaagcccacaggaaattcataaatcaatgagtgcaactgtgtagaatctcatgacacatatatatgctttccgctttttccttttaaacccttagtttacattttcattgaccctgatgtattttttttaacctctcttttatcatt

SEQ ID NO: 390252 - DNA, 437 bp, Homo sapiens
cacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctc

SEQ ID NO: 390253 - DNA, 798 bp, Homo sapiens
atgatggtggctaggttagagaagtagcagcagggatggccagagtggatagattcaagaggtagttaaggaggtagaatccacaggtctgtgggactgatgtgctgtggggactgcaagggagctcagatcatgtctaggtttctttctattggggcacctgagttgatgatgatgcatttactaaaataggagtagttggagcagacaaatttagttttcaactggaaagtttaaggcacctgaggacatcaatggagctgttcagtggttatttgaatgtgtggatctggagcctgaaggacaggccaagttgagattctaggtttggggatcatgagccatggaagtggatgaaccactgttaccgtctctgtggtattaagagccaaagggcaagttcttagccatgagaaacaccaacattaggggatgagtagtagaagaggggcctgcagggcagactgatgaatggccaaagagagagatggaaaaagagggatgtggggcagggatgtggggcaggcagagctggcacatgcctgtcctcacagctacttaggaggctgaggtgagaggatcacttgaagccaggagttcaagaccagcctgggcaacatagtgagacccccatctcaaaaaaaaaaaaaattaggcatgatggcatatgcctgtgatcccacctactcaggaggctgaggctggagcatcccttgaacccaggagtttaagtctccagtaagctgtgactgtgccactgtactccagcctgggcaaaagagccagaccctatctctt

SEQ ID NO: 390254 - DNA, 626 bp, Homo sapiens
ttcaaggagaccaagtggggtaacatgagcatgaagtgattaacctgcttgaattatttgtcaactgagattccatgtgttttgctcatctcaccagcatacagaaattagcctactagagattggcctttggccagatgtacaggacattgttgtctgcagtagatgcagaaaatataaaaatgctgtcagctctttccctaccttcaagtcaagaagcttttccaggacagggtcatgtcttcctcatctttgcttcccagctgcttggcatatcatctgtcgcagagcaacttctcagtatacgttgaaaaatacttctgaagtgttctgctccaatcagaattttgccttaccttaaggatctgaatagcatcacatcagcatttgtattcctggacctgaaagagaagaagatgtaaagttcctcagatcctacctgttcagacacagccatccttcagtgtcatctctgtaccgaagacctctccagctgcatcaacctttccatatcctaaatgccttaatcttaatgcaactttggaccacgtaaggcattctctgatttagtggttctaacgcaaggtcaatgacacagtggctgtgaaataagttgtgagaagaaa

SEQ ID NO: 390255 - DNA, 365 bp, Homo sapiens
tagctatatacagtaaaagttcaaaaaatattagacaataataatggtaatggtagtatcttgttaacttaactccacctttctagtgtcttgcaacattgttaatctctattcagatttccaggcttgagataaccacctgtagtggttcatggagatacagttatggctttttatcatgctttccctcccttcttctagcaggggaatctctattacctttgggaaatacattccttcacctcactgcagtataggagtgggcagatctaccaaaactacatgaaacaggttatatacaggttatactgtttctttcttcctttggtaccttaagctagaaggactaataaaatctgaagctg

SEQ ID NO: 390256 - DNA, 693 bp, Homo sapiens
gctggagtgcagtggctcgatctcggttcactgcagccttgcctcccaggttcaactgattctcctgcctcagcctctggagcagctgggaccacaagcgcacatcaccacgtccagctaatctctcatattctttaaaaaaatttttttctaagacaagccaacaaaacttctatagctatcatacatccacaaaaagatgtttattgtggcatgcttagtaaacccatgcaaataagagagaaaaatataactgtcacatccacacatggtatgctgttaacattttgctgctttgtctttctgtacatttaatgcctttttaacaaaatattattatacttaaagtatgtactattttgtaatatccttccttagttaatgatatatcttcaacatcttttcatatttttaaatagtgctgtagaagcttagttttaataataaaatcaatttcaggctgggcgtagtggctcatgcctgtaatcccagcacttttggagatcgaggtgggagaattgcttgaacccaggggttcataagttatttatgtatttatgtttataaagacagcgagaccctgtctttataaacataaatacataaataaacaacaaaaactacatttcattaaatagtactctaatgtactctaatgcattaagtcagttcaagttgtttgcaacttttttg

SEQ ID NO: 390257 - DNA, 227 bp, Homo sapiens
tgtggagaattcttctggatcttattcagggccaccaaggtggtaccagtacgagttaggaagaaccacagtgatcctgggcttgcagtgccccttaatgcagatatggattaggtcacggcatccaaatctttctgaatacctataaagccttcccaaggaggatgggtacaaaaaagcccctatagcaaagactataataaatacttaacccttccatgtccaga

SEQ ID NO: 390258 - DNA, 385 bp, Homo sapiens
gtttggcagcagacagggatttgtacccagatcgcctgacttcggagagtatcagctcttaaccacagcacttcggtctatgccttgatttcaccatatgtaacaagcagctgtgccactttgcattcccaccagcagcacgcaagcgttcgaatttctccgcacgctccccaacaggacaggagcttgccgtgttgccccaggctggtctcaaactcctagcctcaagcaaacttcctgtctcggcctttcaaaaccctgagattacaagcataagaaaagaaaatcttgtaagatgaaagctgaaggatgagagcaattaattgatgaagtatgatgatccaggtgtccctgggtgaagaaacaacctcttacaaaggccctg

SEQ ID NO: 390259 - DNA, 562 bp, Homo sapiens
ggcatttgacaggaagaatccaaaggccctgaatacagctgaggaaggagggtgttggaaatcaaattcaagtgaggattaaaacctgaattcacattttgtgcagtggattctacttctagaaatgtatcctaaggatatagtctcagaaaatacatgtgcgagaaagtttattttggcattgtttgcaatgagcataaaggtgggaacaacctaaatatttgttagcagatgagctatattacagtgctcccacacaactgaatcccgaactgccttggcaaagcaactgcaaatgtgctatatataaaggagtccatgatgtagtgtttaatgcagaagaaatttatagaaggggttgtgtaatattacctcatttttattttaaaaagtatccacacatcaaacactatatttctttgtacttaaaaatatttttaaaataaaacataatggtgatgaatgggtggatgagtggaaagtccattgaaagggatatatatgtatatgtgtgtgtgtgtgtgtgtgtgtgtgtgtgtgtgtgtgtctcacatggggaaga

SEQ ID NO: 390260 - DNA, 337 bp, Homo sapiens
cttctggttctcagcctctgttctggtggagagcatgggccaaggagtgaggcgggcctgggttcaagtccagatgatcttttctgttaaatgaggacaatgggatctttatgaagagcagagaatgtatgaaaagcatctactcagtcaaggaactaatatttactgagagcctagatgctctaataaatgccaggcattggataaacgttattcttctcagtctcttgctgtccactgggtccctccactctgcctcatgcaaggatggatctccagggtcttgcaatagcttttgctcccctgcttccctctctataactcagctccccttctt

SEQ ID NO: 390261 - DNA, 405 bp, Homo sapiens
gccaaggccatgtccagggaaatgaagcaagatgatcaacaataatgttgtggctggtatacgtgcctactactgctaccaccacgctaatcagatctcagccacttacagcttcatcccaccacgcagtgccttctactcatgttccacatcgtgctttccataaactaggcttgacactgcctcctcaccaggtggcactcaagctcagaagcagaaggggacccaggtggggacactttaataagagcagtccgtgatcacaatgaattggatggaacaaacacacttcgaaatggctctctcccacgtgtaaccacactcaagaattttttctctcttatgcagttatgaagtgctatggactggcaaagaaaggcagtgggttctggtcagctcttacag

SEQ ID NO: 390262 - DNA, 574 bp, Homo sapiens
gagccagatcagtgaaggccaccaagtaggagtgatgagtgagataggacaagattcagaggaggaaaatgttgcagaggtttaggacaaagtgtttcaaggaaggttgcccagtgacatcaaagccagtagaggagtcagaagaatgaggcctcaagcctgccaggtgcaaacctgggtgtggcatttctcctgaaggctccctctcctgcgatacttcccccgcccccgcccccgccccccatttggtggatggtgccatccttctagcctgtaggctaggggacacatgtaggtcatctcagaaccctcttactcctgcagcccctctgaactcttcccactggcctttctcacctgccttcctcttttcctgtggctgttccttgccacacactctgttcccactctcccaattccttcttcctcactagcatcttcctattctgagaatgatgggctactaaaccactaagacctgactcaggaggtttcctctgcctgaaggccatctccctctgctcccagagaatggctgctcacgtctctgagcctagctccaatgctacctact

SEQ ID NO: 390263 - DNA, 852 bp, Homo sapiens
tgggatgaatcccacactatggctatggtctgcatgtactgacatgcacagagtaattgtcctgtataattgaaaacatgggcactgagttttatatccctgacagtcaaccaatgtcaacgagattttatggtgaatttatggtagcaggctctgggtcctaggttaatatgccttctgcctctgtaataagggtccattaaaaaaaggagaagggaggatctccgaaacccagcctgaggctcaagctctgctgcttaattagtattaaatggcttcctggctcaggagttacattgaggctaacgtttccttgaagagaagccctgattttaccttcctgtgtcattcagcccaacacctgcacccatgaatcattatatccagaggagaccacttccctctcatcacagacatctggggaaaactcctacctcagtaatgcttgatgtttgacacaactttggaaaatcactggcagttctaaacctgctgttcaagaagttcaaacattaaggctgtcaaatttccagccactgtgagctacttaatgagcaagagatgcaaattggcttcatgggcaatggtcgtgattgccacagacagcttgtggcagcaaggcttcctagcaaacataatagcaacacgtgcatttaattaaagtgatgtctactactgaaggtggttaaagtgccaggcctgattcttgcgagagatatatcactccccgcatttaaaacctagagaaacaaatttagagatgctaaatactcacacccaaccaagaacatggagcagagcaagattttgaacccaaatctgtctaggctctttgcaggctgttatatgccc

SEQ ID NO: 390264 - DNA, 424 bp, Homo sapiens
  misc_feature (308)..(308): n is a, c, g, or t
  misc_feature (379)..(379): n is a, c, g, or t
aggatccggtgcagagcttggattcagcagaggtggctgttgatgtgaccagtccccctgtttgggtgggaaggccctgaatgacacatgcagcaaggctttaccccataaagacaaagaaactggctgaggagacaagagaaagaaagtagcagaagatgggaaggaaacagacggagtctcacttgtgttgccaagagagcttgagcatcaactggcagtgaggatggcaggaaagcaactgacttatcccctctcaccagaccttccaactgtctgcaacactggcattgccacgtatcccgatnccattgtggcattgtggtcagaggatttacaattcgctgaagatccatgtttttgggcatcccgggtagtntcatttaaaaactcttggtacatgtaatggatttattcaaaatgg

SEQ ID NO: 390265 - DNA, 749 bp, Homo sapiens
agcgatttcctgttaacacctacatttttgctgatcaagcaaggtctgttggtgcaagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacagggagaaagtataaaagtgagcgcttcaagtgctctagtgtacatgtcagaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttcttttgtccagccttccttgattagccttcttcctctcccttctacccattgtacatggtttctgttgccatgtagtggttaaatctggtttacgttgtagttgtttgtgtgtaaggaggtctcctacaccgggccatgttttcttaaacactgggatggtgttttcttagtgcttgtgatgttctttgtaacagtgggtgccctataacttttgtttggactgaatt

SEQ ID NO: 390266 - DNA, 621 bp, Homo sapiens
atttattaaaataaaaacataggtgcctgggaccagaattcatttttataaaatcacaactgttcactatataacactatgatttctttttgtgtttctgatattttcctatctaaaagtgacatagggttaaaaaggagagaaagtggatgtagaacaatatccaaacattggttccctgcttcagtccataattgtcattcattttttattgcctcaattccagttatcaaaaggtaggtactaatccaaactgcatttcacctcctagcaaaggagttaaaatatgtcttattgttctccatgttctgtatgaagttcttactttgaaatgcagggcccttcattctttggcttaatcctctgaaactcactgaattttctagccttgtcatctaccaaaatgtgcacatattgttgtaccttgggctgtcttaaaaaaagacatcatgaactctggagccagactatctagatcagaatcccacctgtaccacttactagctgtatgacctggggcaagtgacttaacctctctttgactcagcattctcatctatataataagaacaattaaagtatctgacaggagaatcaaagcctggccaaatgaaacaggaa

SEQ ID NO: 390267 - DNA, 568 bp, Homo sapiens
gaatactaggagctaagttttggacatattaaggttaagacgttattagacagccaaagaacatttcaacctttggactcagcctcagctacagtgaactcactagaaagatagttattttctggcataacaagggaaggagggggaaggcagtcttgttaaatcaagtgacattgatggggactggtctaagagcagagtaagctgctaaattttgcttgaaggaaggggaagcaatgagagtctgtcaggacagacacacacacacacgcacacacacatttttttctggtattcaccaggacagttttaataaaagtggcaatctttataatagaaatttctcaccattcggtaaaactgatatttcagtgggaactcctgctggatataatcataatttgaaataaaatgtgacaccaaagataggaagagatggcttagaaggtagaagaatcactttgggtattctcttgagcctctcaagccaagccattaaattgcttcggaatggtctaagtcaaggactaaacctgacaaacatgtaggagcaaatgctccctgagaa

SEQ ID NO: 390268 - DNA, 227 bp, Homo sapiens
tgaagagggcatgaggtgcttgtctgagactgatctcctcctgctgagtccccccatcagactgtccttcctctgcagcgagtgtctgcagggtctgaatgcgggaaaggaattctgatctgttgaaatttgtctcctctgtgtgtcctgcactaaatgcccaaaccccagcatgggacttaatgcagagagggacacaggcagagtccaggcctgagaatcctgtg

SEQ ID NO: 390269 - DNA, 266 bp, Homo sapiens
cggccaaaggacgatgttcatttaaatcaggactgaggccagggtgaggcgagggaggtgctggtgctgcaggtcccacgacactcactctcagggtcatgggcacctaagacgagatgccaacatccatgctgtacccaggcatccctcccttgcacttaaacctcttgactggtgcgggttcctgcagaggcctgtgggaccgagtttgagaaccacaggggaccgacaagcccagagctgctgccccctgggaatcaggccca

SEQ ID NO: 390270 - DNA, 163 bp, Homo sapiens
cagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcc

SEQ ID NO: 390271 - DNA, 767 bp, Homo sapiens
cagtctcccccttcaacatctctctctctctctctctctctctgtttttttcttaaactgatatctatgtgaaatgagctgaagttcacggtccagttaggaacggataatacattcattgtcctggcagcaaacttttttttcactccctggaagaattcacgcttgccgcaagaataataattacggaaaactagaaatgcactgctaacaaattaatccttaacggacaccaccctaacgagggcagtaatgatttgaggactctcttcctcacgggacttgcatctcctgtgacaatgagctattgtgcatcctcacaactcactctacctcttatagatccaaaatgtcaaaggttgtctgtcctggttgaccatgacatgtgagttaactcattctgctgctgcatggcagaactttattcaaactttatttatatccagagtaactaaaagatagagtgtgtgggtcttttccactcagagctagagtgcctaagagacagaaaacctgctctgacataaacggagaaaagttagatgagagctgtgggaccctgatggaaaatagggagtggggacccagagttctctcacaggtgactttaggcaatccagttaattggccaggactagaattcactcagaggttgcttctccctagtgcccaacacgcgtcctcagaaaatgccacagccagagaaaaccatacaccccatagtccctgaaaacaaaagtaagggggatgtgaaactggagagaggg

SEQ ID NO: 390272 - DNA, 773 bp, Homo sapiens
gatcgcaccactgcactccagcctggacaacaagagcaaaactccatctcaaaaaaaaagaaaaaagtacctgactccttctgtacgtgctgcctttaattctctatgcacacttgaatgtgtttaaaaatttgaaaagcactggttaggccgggcgcggtggctcacgcctgtaatcccagcactttgggaggtcgaggcaggtggatcacgaggtcagcagatcgagacatcctggctagcacggtgaaaccccatctctactaaaactacaaaaaattagctgggtgtggtggcgggtgcctgtagtcccagctactcgggaggctaaggcagaagaatggcatgaacccgggagtcgacatctcgttactgcactccagtctgggtgacagagggagactcccatctccaaaaaaaaaaaaagaaaagcactgatttattctaataatagcttcctttctataatctctccctactattccatctgtatcacaattatgtcgtagtggctgatattcactatttgaaatacagtcccagcactttgggaggccgaggtcaggggttcaaggaccggcctggccagcatggtgaaaccgcgtctctactaaaaatagacaagttagccaggcgtggtggcacacgcctgtggtcccacttactcgcgaggctgaggcgggagaaccgcttgaacccaggaggtggaggttgcggtgagctgagatcacgccactgcactccagcctgggaacacagtgagactccatctc

SEQ ID NO: 390273 - DNA, 689 bp, Homo sapiens
gggcaagatagccgactagaagcagctgcagtttgaggctcccactgagaagaactaaaagagtgtgcaaatcctgcaccagcaactgacatatccaggttctatgatcaggactgactaggtggttgccgtgacccatagagaacaaggaaagatgggctggtggattggcccacctgggagccacatggggcaaggggagccgtcaccctcagccagccaagggaggcagtgagtgagcatgctacccagcctgggaaactgctttttccatggatctttgcaatccacagatcagaagatcccactcatgagaccacaccacgagggccttgggtgccaaccacagagccatgcagattctcaacagccactcagctggagtctgcctaaaactaccgagttcccaagttggggaggggtggtcatcatcactgtggctgcctgctgcctaaaccctctgagttcccaagaagggacagcagccatcactgtggctgctagctgcctaagacactgaactcctggggaggaagggcggcagccatttctacagatcccagctgctgtttttcctttgctgatgccaggaagactggacggcttggtcccaagaggtattccccacagcgcagcatactgggtgtggcagatcattgccagactggcttttttagctggacctgaca

SEQ ID NO: 390274 - DNA, 940 bp, Homo sapiens
tggatttgctgatcaaaagcaccatcttccctcgcctgctgctggcagcctttccttgccttgcttgttagcagagcattctgcttacccatgtggctcccagagttagcagccccggctcttggatttcttgattcttctcccctgtgatctcagaggtgctgcagaggacattcccctttagagcaagtcatgtttctattcaggccacaaaactgggatgtacatgcagtgactttggtgttccttgtcttgttcaggggaacgggtgggactgttgtgtgctgtcaccctcttcattccatgagcaccttgttcacttagggtctgctgcctttttttttttctttttcttttttttttttttttagtttttggggatcggtgtctcacctcctgtgttggcgccaggctggagtgcagcctccaaagtagctgggattgtaggcgtgcgccaccacgcccggctaatttttatttttttagtagagacggggttttgccatgttggccagactggtctcaaacctctgacctcgtgatgacccccctcggcctcccaaagtgctgggattacacccagcctctgctgccttttcatatttccccatctgctttatggatcaactctcaacagtacactttttcttttctttacctaccctatgagtgcaacccagatgtaagagttaatcctcgtcagagaatcattgccttaaacctctcagaaatatgtaattaggaaatcttattttaattttttaaaaattgcttgtatagtttcaaagaataagatctggcaaatggccagatgtggtggctcacacctgtaatcaaaccagcactttgggaggctgaggcaggcagatcacctgaggtcaggcgttcaagaccagcctggccagcatggtgaaatcccgtctctactaaaaatacaaaa

SEQ ID NO: 390275 - DNA, 726 bp, Homo sapiens
gcagtgactacctgaagtacgtgctctccaagtaagttcgtgctaactttagcaaggaaaaattgcgcttatattaactctagtacctaatgactgactgtggcattcagtttaaactggtttgagcactgacttgtcttaggaagattttaattttaatccagtcaatctttagtgtttttttcctaccctcttctcagatgtaaattacttagtgtcaatccaatcactgtgatatgtcaagagtttactaactacacagggtgccgatggaatgggattttaatgttatagcacagcctggttgctttgatctgatcactggaagaataaaggcaacactgtgatgctgagcactgcagtgggctaagtgttgggtgtattatctcattcaatcctcgtcacaaccctgttcagttagcgtatatgtgctcatgcagatggaggcccacagaagttaagttattgcccaaggtcacacagctagtgtgtggtggagccttgtaggacagtgttttcttttaaggaaggtgttttgcccacagtggctaggataaacgtatttgaattttccttgtagagaacaagtactttaatgctctcatagactgacacccctaatccaagcaaactgtcatagactaagcatttattcttccttattgctgtttggacaactctgatcactttggtaattcttttttcattcttagccttaacttgttt

SEQ ID NO: 390276 - DNA, 427 bp, Homo sapiens
ctgtcatgaaagccactgaaatgtagccataaaaaatggggtgccatctcctcttgcacctctaaacatctggcaattatcatgggcaaagtgccttttaccccactaaagatactcaattgcattctgttctgtaacactaactattctttcatccatttgacctacataaactttcttcaaattttaaaaataaaaacaaaaaataaagatgatgtatgtctattagcacaaaacaagatgggcaacctgaccaaaaaaggggccctgatttccaagttcgcaatgatgccgtctctcacagtgattaccaggctgtgagagggtgtggtctataaacaccgggggtcccctatagaggagctgtgggggtgtgagcttgtggcaggggcgcgcgcgtacaccgtgcgcgagcagggagagacgg

SEQ ID NO: 390277 - DNA, 669 bp, Homo sapiens
ggcgctcttttgcggtggaagcaagaggatcaggcaatgactgttctctctgcctgcttccaacccttggctggtgttgcacttggctcctggctcccctactggtgtcagtatctataaaatatcaagagtttctagttcactggctattacgggactccagaaggttcccttttatactagtttattgctttaagcattttcctttttctccagttacctgaatcacactaccaggaaatagtgttacctgaattgcctgcagtagttctttgagtctgagccaggagagaaagaataggacacactgctgctgtctccgaaaagtcagatgtacttaagaccctttgtctttgggacgactttttcaccgccaaaattgggttttctgctgcacaaaatttgttctgttgagataaagttgatgtaattcagtttcaatgccttaatttaagtaatgtccaaaattacaggaaatccaaggagcaaggcagacaggttctaccagcagtctgtctcaccatcccaccaccttgcaggcttttctctttgcattagataggaattgacctttttaccttggaatgatttttagcagcatagagtaatcgtttaccccatatattcgtaagcatctcttatggcttgaaaacttactgtcaaagatgt

SEQ ID NO: 390278 - DNA, 905 bp, Homo sapiens
aaaagtgaaccgtttagatgaaaccataagaatcttaaaaggcttagaatatgtaggcggggtgcagtggctcatgtctgtaatcccagcactttggcaagtggagttgggcagatcccctgaggtcaggagttcaagaccagcctagccaacatggtgaaaccctgtctctaattaaaaaaatacaaaaattagctgggtatggtggcacgtgcctgtagacccagctactcaggaggctgaggcagaagaatcatttgaacctgggaggcggaggttgcagtgagccgagttcatgtcactgcactccagcctgggcgaaagagcgagactctgtctccaaaaaaaaaagaaaaaaagaaaatgtaatatattggccaggtgtggtggctcatgcctataatcccaacacttggcagaggctgaggtgagtggatcgcttgagcccaggagcttgagaccagcctgggcaacacggtgaaacctcatctctacaaaaaatacaaaaattagctgggtgtggtagtgcatgcctgtagtcccagctacttgggaggctaaggcaggaaaatcgcttgagcctgggaggcagaggtttcagtgagccaagattgcaccatcacaccccagtctgggtgacctgagtgaaaccctgtctcacaaaaaaaaaagaaaaaaaaaagaaaaaaatgtaatatagcagtatggaatatgtaaatgaactaaaaattatgatactgtaagtctcattaatttagaatctagtaattaaaatttttgaacatttggactatttttatttaggaaacaatatcttctttcatataaaaagtaaactctataaacattaatcagatcatgttgcctaatggatttagaaaaaggaaaaatgaacagaaatgtat

SEQ ID NO: 390279 - DNA, 379 bp, Homo sapiens
cccttatgggacaggctgaggctggaagtttgggagcagcagaggactcagaggtgccagaaagacggggtcctgaaagggtgagtctcactacacacagattcagggacaagcagagatttggaaagaagttcttactttgtttcttgagcctttaggcagaggcaccaatcactgtgccaccctttgtttacacagtagatcaccaaaactgacagcaacacagaaaagtaggtactgggtatcccatttcacagacaagactactgaggctcagagaagctgagtgacttgcccaacgccacagagctaggagatgaggagcagagttttgaacccagctctatctgctgtcgggctagtcgggggggtaccgagc

SEQ ID NO: 390280 - DNA, 481 bp, Homo sapiens
gagttcccagacacattgttagtaatgcttcatttaatccttgcaacaatccgtgaaaaatatgccattattgcatccattttgtaaatgaggaaactgaggcccagagaagttaagaaacttgcccaaagtcacacagcttgttagtggcagacccaggactgaaatcgaggcctttgggctctagagatgctcaaccgattcgcattcacagtcctcactatttgcaaactacagctgggtgcagggggtattaaaaatgcaagtgatcaccaccattcaaacacttgtaattacaggaggagctaagacccatgtgcataagatgccactcctttcttcataagggccatataatagtaacagtaataatagtaataatggcaaaggttactaattcttgagcacttataatgcaccgagtactgtgtggagcatgttacataaattaacttatgcagttttcatgaccaccttgtaa

SEQ ID NO: 390281 - DNA, 646 bp, Homo sapiens
  misc_feature (640)..(641): n is a, c, g, or t
atgtcagtgatcctcagtatcacaccactaaaggggatggaaggcggccattagacaaacatcccattatctcatctacaagcacgctgagttctgaccatggactagagtctgatgaacggtggcgtgagcagagagaacagtgagaagaagacacatctgtcctttgtttcgttgcatggccctgcttgaaggtgctcaaatgggaaaatccactcccgatggcccacaggtgctattcctcaggtttaacagtccttagcgatgtggttttcaacaccagctgaacatcagaaccacctgggagtctttactttgccagatgtccccaggatgtctaattaaagtggttctctgtgggtgggacccaggcgtgagtagctgttaaagcttcccaggtgatgctaaggtacagccaggactgagaaccactgccgtagagaaatccctctgcctctgtgccggtacgtcaagacagaactaggtagggtcaggggctcaggttaaaaatagcacactgcagggggccaggcatagtggctcatgcctataatcccaggactttggcaggccaaggcgagaggatcacttgagcccagggtacgagctcgaatcgtatcagctagggttaaaaaaaaanngggga

SEQ ID NO: 390282 - DNA, 1136 bp, Homo sapiens
tgagctcaggtgtgtttttcttccaagctttctagcaaggtttctacttaaaatcacctgtgtgcaagcccaaaggacatttcatctattctaagcagaaaggctgttttgttcattacagtgagtgctgttcatctcatggagtgggaggagcactaaaccaggagacagaggacatggatttggtttccagcttaaccagttaggactctgtcctctgcattctggaaccatgatgcctgcctgcctgcctcacagggctgttgtgaggaccagatgagatgatgtatgttcatacttttggaatctctaatttaaagtcttaatattttgtcttctgagtgtgaggggataaacctggatgtagactattaagcagcataggagaaaagaacaatagaatctaatggactgggtttgcaatctctctctaaatgcactgcttcagacaaagtgaaatccaaaggtgtgaaaaagtatagctgcaaattggaaaaatgtgtttcaagagtcgtctttttggccaggcatggtggctcacacctgtaatcccagcactttgggaggccgaggtgggcagattgcctgaggtccggagttcaagatcagcctggccaacatgatgaaaccctatctctactaaaattacaaaaattagccaggcgtggtggtacacgcctgtaatcccagctactcaggaggctgaggcaggagaattgtttgaacctgggagatggaggctgcagtgagctgagatcacgccactgtactccagcctgggcaacagagcaagactctgtctctaaaaaataataataataataataatttttttaaaaagaggtgtttttgaggtcttagatgttcaggttgatgatcctgcagagggaaactttccatgggggggtggggagagagagttttccatccacaatatagaaacagagaagcactgtgctccctctgcaggaccagccttcccttatctaaggggcatggagctcagggaggctttattccatatgcacgggagaatcaggcagaatgaacccctacccatctttcttggcttttcagtcattttgtgctgttttctctggttcattaataaattgaaactgccctccaaaaaaaaa

SEQ ID NO: 390283 - DNA, 567 bp, Homo sapiens
tgtgtgtcctccaactttgtacttactattagtttattaatttctacagtgaagcctgttggattttctcggagaattgtattgagaccagatcatttgggggagaatcaacatcttaatattgggcctcaatatttcataattttcaatgtagcagtcttgcatgcctgtttaaaaatttattcttaagtattttataattttacattactgtcagtagaacttttggatttgactttccagttgtttgctgtcagtatgtagatatacaattgatttttgtatagtgactttatagtctgataagtctgtttcacttattacttctagtggtttgtttatatagaaaactaagaaatttgcaattatgtttcctgtgactattgttttacttctttctttctaatctttatgtcttgtcttgctttttattggtttattatactgtccaggacttccatagtgttgaacagaagtcacgagaatgggcataatttgctttggtttcaaagcttaagcaagaaagctttcataagtccacccatatgggattgatgtcttgtccga

SEQ ID NO: 390284 - DNA, 339 bp, Homo sapiens
ctcggggctgttggcgttcttacttactcacttgtagacatagcacgcttcctttcagccccttctactcacttgctgaattcccagccatcaaggcagcaagcttcacttctcaaacatcagttcaaagatcaaattactggccgggtgcagtggctcatgcctgtaatctcagcattttgggaggccgaggcgggcggatcacctgaagtcaggagttcgagaccagcctggccaacatggtgaaaccccgtctctactaaaaatacaaaaattagccaggcatggtggcgggcgcctgtagtcccagctactcgggaggctgaagcaggagaatcg

SEQ ID NO: 390285 - DNA, 134 bp, Homo sapiens
ggagggaaacgcagggaatgaggcgtgagctcctgccgcccccgcccagctcccagccgacccgccgggggacgacccctttctggagacaagaacgtcgagtccgacccggccaggtgtcgcctgtctgaggc

SEQ ID NO: 390286 - DNA, 379 bp, Homo sapiens
aaaaatgggaccagtcccagggggtggacacttcctgttcttccagttttaaaatttttgagatcaaaagattgtacccttccatgactcaggccctaagattctaccaggagaagagaatggctttgctccaccctcacgggttttaaacctaggcatctgcccggactccttccttaaacctctgcccagcagcgtctacagaatacccttcttcctccagcacagaagtggatggggtggggcaggggaaggaaaaagcagtgcaggaatttctgcaaccgcaggatgatgcttgcaggagcccggggtgcagtgagtcatgagctctgcccgcggggaaggaggaggggggcgcagggacggagaatggggctgg

SEQ ID NO: 390287 - DNA, 464 bp, Homo sapiens
agagggtccccatccccgcaggatccccggtacttggcacactgcaaagcctgagtatttgtggatcacgtgatctgtgctagtgactatcaggagtctgagatttgaagcgatggatttcccagcatggtcccagctccccactgatgtgaaaggtggtggtgagttaacagctgagccaccacctgctgcccaaccccacgtgtcccacatggccgggcggtgctgcgctaactcatctcccctggatggaaacgtttgcgtggtgacagccgattctcttgagagtcatttgctgcccatgttgctggggagattctgcctcagggccaggagtggtttgctcctcccaccccgggcccagggctgctggtgggaggccccagggaggagcaaggactctaatgcttcgtgtggtgggagcctcaggactttcccacgtgcgacaggcacgttcctgggag

SEQ ID NO: 390288 - DNA, 372 bp, Homo sapiens
gctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattct

SEQ ID NO: 390289 - DNA, 220 bp, Homo sapiens
gaactcgactggcttccatcgcaccacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390290 - DNA, 208 bp, Homo sapiens
  misc_feature (55)..(55): n is a, c, g, or t
ggaagccttccagtaatttcttgaagctgagcgctcaggtgagtagggcgacatntagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390291 - DNA, 2258 bp, Homo sapiens
aatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390292 - DNA, 2242 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390293 - DNA, 2307 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctaaaaaaacacgaaaatctgcaaggaaacatatacgggccggcaaaaagaggttagacaggacatga

SEQ ID NO: 390294 - DNA, 2544 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctaaaaaaaaaaaaaaaaaaaaaaaaaaaaaaaaaaaaaaaaaaaaaaaaaaaaaaaaaaaaagggggggcccgcaaaaaaaattcccccggggggcgcacccaatgtaacacaggaccccgagtcttgggacagaagggcggccccaatagagagacgaccaattaacaaacacaagacgagcagggcccggcaacacacaccccaacaggggcggggaacaagcgagaaaagagagacacacctgggaaggagacccgcacaacgagcggcgggcgacaaatggggggacaccccccccacga

SEQ ID NO: 390295 - DNA, 2249 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactcgggtcgttacacaagctcattcagtgggcagctcgccagtt

SEQ ID NO: 390296 - DNA, 2181 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccagggttaagggctaaccggctggctcctctatcctcg

SEQ ID NO: 390297 - DNA, 2013 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccactggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390298 - DNA, 2028 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctctggagttgggcaggcctctggagtgtctggtcaactcttccgctccg

SEQ ID NO: 390299 - DNA, 2144 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccagtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390300 - DNA, 2287 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaagaggtatccccagtgatgatgacttggaggttcccgggggctcacctgggttcaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390301 - DNA, 2430 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccaggtatccccagtgatgatgacttggaggttcccgggggctcacctgggttcaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390302 - DNA, 2062 bp, Homo sapiens
  misc_feature (5)..(6): n is a, c, g, or t
gacgnntgggcgcgagcggacgctcgcgatctacagcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390303 - DNA, 1862 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcacacgccctcgaggttgctctgggatccccccacagcccctggtcagtctgcccttgtcactggtctgaggtcattaaaattacattgaggttccta

SEQ ID NO: 390304 - DNA, 1698 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgatggtctgaggtcattaaaattacattgaggttccta

SEQ ID NO: 390305 - DNA, 1787 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgaggaccgaccgctcggacgacgtatactactaacagaccgcaaccctcaacaccaccttgcttcgaccccgccggaggagaaccccattctataccaacacctattctgaggaatcctcgagacta

SEQ ID NO: 390306 - DNA, 2407 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccgcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagacagcccaaaaaacccttggccaggggcccaccggaagcaagcaagaaccgcttgggtgatggtcctgcaccaactgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390307 - DNA, 1819 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaagccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390308 - DNA, 1763 bp, Homo sapiens
atacgaatcgagctggtaccccccgactagcccgacaggtcatcatcatgtcttctgtgtatacacgccacctgtgccgcctccactgccctgactggggccagctccgaccctggttccccgaagggaatctgaagctgccaaagccccccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390309 - DNA, 1640 bp, Homo sapiens
gcatgcgtgtgtgtgcaactgcgtgagtgcatgtgtgactgcgtgtgtacatgtgcatgcatgagtattgcacacacacgcatgctcactcccacactgtgtgcactcaggtggctgtgttggacagttgggcccagggctcccctgctgtcctgtggggccggcatctgctctccttctttctccccaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390310 - DNA, 1421 bp, Homo sapiens
ttctgaggagtcccggtgtggttcttgtgctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390311 - DNA, 1290 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtcccttttccagagcgatgggatcgctctagagtcacc

SEQ ID NO: 390312 - DNA, 1124 bp, Homo sapiens
tgattagaggatcctgtggaggcaggaagagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390313 - DNA, 1144 bp, Homo sapiens
  misc_feature (1025)..(1026): n is a, c, g, or t
  misc_feature (1043)..(1043): n is a, c, g, or t
  misc_feature (1049)..(1049): n is a, c, g, or t
  misc_feature (1053)..(1053): n is a, c, g, or t
  misc_feature (1057)..(1057): n is a, c, g, or t
  misc_feature (1059)..(1059): n is a, c, g, or t
  misc_feature (1061)..(1061): n is a, c, g, or t
  misc_feature (1068)..(1068): n is a, c, g, or t
  misc_feature (1080)..(1080): n is a, c, g, or t
  misc_feature (1144)..(1144): n is a, c, g, or t
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgctaaattctggctggactcgagcttnngaggcgagctggccatntccaanactntcantntntgcagangactgcgtgcangagtggctatgagcgtgaactgagtggggagtctcatagagtgaggtgtgaaatccttcctaan

SEQ ID NO: 390314 - DNA, 985 bp, Homo sapiens
ggtcgtgtcggtccgagtggtcctgcgagggaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390315 - DNA, 857 bp, Homo sapiens
tctgcagaggaccagattgtcacaggaagggaactggggtgttgtggagtctggaaggactgataggggtagtatctgtagtcagggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390316 - DNA, 921 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacaca

SEQ ID NO: 390317 - DNA, 495 bp, Homo sapiens
actagtgactttgttttcgtagcaatggtgcgatctgagccgccatattggtgaggccaggacaggtacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390318 - DNA, 360 bp, Homo sapiens
ctgacttacaggatcttaaacgacccgaaggtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390319 - DNA, 236 bp, Homo sapiens
  misc_feature (21)..(21): n is a, c, g, or t
atgcccttcggcggccggccnccggaaaaacccaaggaggcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390320 - DNA, 473 bp, Homo sapiens
  misc_feature (334)..(334): n is a, c, g, or t
  misc_feature (336)..(337): n is a, c, g, or t
  misc_feature (341)..(341): n is a, c, g, or t
  misc_feature (361)..(361): n is a, c, g, or t
  misc_feature (370)..(370): n is a, c, g, or t
  misc_feature (372)..(373): n is a, c, g, or t
  misc_feature (396)..(396): n is a, c, g, or t
  misc_feature (400)..(403): n is a, c, g, or t
  misc_feature (440)..(440): n is a, c, g, or t
  misc_feature (451)..(451): n is a, c, g, or t
  misc_feature (458)..(458): n is a, c, g, or t
  misc_feature (473)..(473): n is a, c, g, or t
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggaccttacttantnnatcntcttcttcctttcccttttnttctataantnnacccattctcttttcatatcatncttnnnncaattatcattccccatcattctttactatttccatntcactttaacntattccncactttcctacttcn

SEQ ID NO: 390321 - DNA, 430 bp, Homo sapiens
cggagttctaaaatggggttgccacaggaccctaacttttcaggccatctaagcaggcagtggttttggtgttagtggtgattggtgaccaaggctggggagtgggggctccggagtcagtaccaccaagtctccatgcggagctgctgcctgagtcgggggagcagcacagagcagagggcctaaagcgggggcctggacaggcttggccaggtcctagctgctcttgttccccagggctggaaggggcggggcctcagggtccaggaatccgacacttccggtctctcttgtccctcgtcttcccaggagccttccagagtgaatgaggcagccacaaatccctcactttcagatgaagacactgaccccagagagtggcagtgccccggctcctaacgcagcccacttccctcccgccccttcttag

SEQ ID NO: 390322 - DNA, 426 bp, Homo sapiens
ttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctaatttgtttgtacagaaagtgt

SEQ ID NO: 390323 - DNA, 367 bp, Homo sapiens
ctgacttacaggatcttaaacgacccgaaggtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactcgggtcgttacacaagctcattcagtgggcagctcgccagtt

SEQ ID NO: 390324 - DNA, 2233 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390325 - DNA, 2185 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390326 - DNA, 2307 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggctggagtagctcgtattacccaggctggagtaactctgtattgcccaggctggagtagctcgttattgcccaggggtggagtagctcttatgcccaggctggagtagctcttattgcccatgactggagttgtctctatatgacggtcccacggtgtcct

SEQ ID NO: 390327 - DNA, 2193 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgcgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390328 - DNA, 2056 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgaggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390329 - DNA, 2376 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccgcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390330 - DNA, 1830 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcacagcccctggtcagtctgcccttgtcactggtctgaggtcattaaaattacattgaggttccta

SEQ ID NO: 390331 - DNA, 2363 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatggagccttccagagtgaatgaggcagccacaaatccctcactttcagatgaagacactgaccccagagagtggcagtgccccggctcctaacgcagcccacttccctcccgccccttcttagaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390332 - DNA, 1740 bp, Homo sapiens
  misc_feature (3)..(3): n is a, c, g, or t
  misc_feature (25)..(25): n is a, c, g, or t
  misc_feature (37)..(37): n is a, c, g, or t
tanggctagtacgaggctgggttgnatcggccgaggnaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390333 - DNA, 1989 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390334 - DNA, 1568 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactaccccttcaatgataaacgcacctcatttaatgataacg

SEQ ID NO: 390335 - DNA, 2033 bp, Homo sapiens
  misc_feature (1805)..(1805): n is a, c, g, or t
  misc_feature (1953)..(1953): n is a, c, g, or t
  misc_feature (1956)..(1956): n is a, c, g, or t
  misc_feature (1965)..(1965): n is a, c, g, or t
  misc_feature (1975)..(1975): n is a, c, g, or t
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccactggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggttccctcggcgtgtgcaacacgccgaaagcccatacgacgagagccctggctctttggggaggaacacacccgactcatccgagaagccatcagagggcgctatggcctcctgccatattggnattctctgttctaccatgcacacgtggcttcccaacctgtaatgaggtaaaaaagcttcatccattcagggaccccagcaacaaatctgtaatagaagatctcagtgattaaagaatgcaataattacagtgatttcaagagaaaggngangaaaagctncatgtttaancaagtttcaataagcttattgagcagcacggtgaacagggtgctggcttgttgggcct

SEQ ID NO: 390336 - DNA, 1600 bp, Homo sapiens
ctcgtatatctgtactgctgagccccgtaggtcagggcccacattatatttggtcatcattctctctcaagtgcctagcccaatgcctggcatgtagtacatagttcaatagaatagttttttgaatagaaaaaaaaaaaagcaatgaatgatatgattaaatagaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390337 - DNA, 1618 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390338 - DNA, 1125 bp, Homo sapiens
acgctctctctgtgggggacgctctctctgagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390339 - DNA, 1102 bp, Homo sapiens
ggtgatctagcgatcccttgctgaatggcatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390340 - DNA, 1050 bp, Homo sapiens
  misc_feature (3)..(3): n is a, c, g, or t
  misc_feature (25)..(25): n is a, c, g, or t
  misc_feature (37)..(37): n is a, c, g, or t
tanggctagtacgaggctgggttgnatcggccgaggntctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 390341 - DNA, 978 bp, Homo sapiens
aggctgtacggtcccaagccgttaatcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggacgaggtccagtgcacgggaaccgaggcctcactggccgactgcaagtccctgggctggctgaagagcaactgcaggcacgagagagacgctggtgtggtctgcaccaatggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctaccgcagccaggatctgggcatccaggcacggccatgacccctccgaggctcttctgggtgtggctgctggttgcaggaacccacagcccctggtcagtctgcccttgtcactggtctgaggtcattaaaattacattgaggttccta

SEQ ID NO: 390342 - DNA, 441 bp, Homo sapiens
ccacgcgtcgccacgcgtcgcccacgcgtccgcggacgcgtgggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccaggtatccccagtgatgatgacttggaggttcccgggggctcacctgggttcaggtgagatgcaggttatagagaggacactagggaatcct

SEQ ID NO: 390343 - DNA, 454 bp, Homo sapiens
cctgaactcaatctacaatccaagaaagagctgcaccagtgactaaaagatctgtgaacaagaaaaataaaatgtattgtaagccactgatattttgaggttagcatgcagcaaaactaactaatacgctctccatcaatatatgtgtgaacaaattagtaaacctacataaagaaaaatcatacagactttaaatgttgtggatttatggccgggagcagtggctcacgcctgtaatcccagcactttgggaggcccaggcaggcagatcacaaggtcaggagatcaagaccatcctgactaacatggtgaaaccccgtctctactaaaaatacaaaaaattagccaggcgtggtggcaggcgcctgtagtcccagctacttgggaggctaaggcaggagaatggcgtgaacctgggaggcagagcttgcagtgagctgagattgcgccactg

SEQ ID NO: 390344 - DNA, 433 bp, Homo sapiens
catacagtaatttccaatataaacctcactcaaaattacagtcacatgctgcacaaaccagttcaatgcacatatatgatgataagattataatacaatatttttgctatactttttcctatgtttacatatacagatatcattgtgttacaattgcctttagtattcagtacagtaacatgctgtacaggtttgtagcctaggagcaatagatcatactttcaagcctaccatctagatttatataattacactctgtgatgttcgctcagtgatgaaatcacctgagaacacgtttctcagatcatatccctgttgttaagcaatgtgactgcaattgtgctctgctgccagtttatttttgaagctttatttttcaattacttactcatggcaattttataagaatcattaaacaaatttaatccagcta

SEQ ID NO: 390345 - DNA, 345 bp, Homo sapiens
ttttttttttgagatggagtttcgctctttcacccgggactagagtgaagtggcgcgatctcggctcactgcaacctccgccccccagggttcaagaagtctcctgcctcagcctctcgagtagctgggattacaggcacccaccaccatgcctggctaatatttgtatttttagtagaaatgggggtttccccatgttggccaggctggtctcgaactcctgaccacaggtgacctacccgcctcagcctccagaagtgctgggattcgaggcatgagccaccgcgccaggccataaggtcttaattctgattctgctgttttctttctgtatggctggagctg

SEQ ID NO: 390346 - DNA, 210 bp, Homo sapiens
aatgaatggttttattaggttgtgtctgatacttaagcccagcagtggttaaagatataagagcaaataaggatttaagcaaaatattatctgattaaaggttaagtccaatggcaggctaaaaaaatgaatgtagaagataagcactaaagaaactttcaggttatgtgacaattctcagcacttttgcttgtacctaaagattttaga

SEQ ID NO: 390347 - DNA, 374 bp, Homo sapiens
ctgctgttgtttcctcctgtcgtgagtcatacaactttagaactgggtaggacctttcagatcatctattttaaccccttcactttctctgaacttctcttctagcgctgtgcactcaattctcattcatgatgtgatgccttgacctcgctgaaggacaagtagaaactttatgtgccttctctaaaagtgggatttagttagaagatttggttccaatttcaccctacccgtatagacgtgctgagggacctcaggcaagaaaagttattaaggagacttttggaaaatagtatctgaaggcatgagagagagacagtttgtgctaaataaatttttctttccctttcttcccttaactatgtatttttctc

SEQ ID NO: 390348 - DNA, 361 bp, Homo sapiens
ctcatattgaacgcataaatgtgtcaaaactaacagaatcattatttaatttgcttgaactctatattgaggaaactctaaaaagccacaactgttttcttcaaagccttcactgttgggctggatggacagggcaaagggaggttgtgagaaatccagataccaaataacactggccgaagctggtcagaaaagggaatagataattaggcgtaattagcgtgtatgaatcgttgtctctctgcccttagcttgaataaattttgaagaaaaaaaccctagtggtgaaaatcctttgatgtaggaagagtcattgtggcttggcagcataaaggcagtgttttatactttttacataatg

SEQ ID NO: 390349 - DNA, 276 bp, Homo sapiens
ctccggagtcctacagaagcagtctgcttccttcagcgtgtctatgggtcctcttggtatttattgctggtttgttcttgcagttgatctggagctgaaattcacaatgcgagcctctgcatactgctctgtcgggtgctgcaatctagtcttgcctcccatccaccatgatgatcccgatccctaacatgtgtttcttatcagctagaacagcaattctcagatttttttggtctaaggatcttttatactgttcaaatgtattgacgattccaa

SEQ ID NO: 390350 - DNA, 525 bp, Homo sapiens
caaatgacaaacacttcaactctgtcaggatggcagtttgaagaaccagttgaatgtaggaagtgaaaatgtgtaagtatattcaaagatgatgccaagtttacttgacaggaaaagaggagacagcagtgctgttttagtggaatatataggaagaacaagttgaagaaggaatccattttagtattgaacgtggtggcctaacatgacccaaacctgtgtttagtattggatatgctgacttacagatgcatgaggaacacttaggtagagatatccagtaggcattgaatttgtgtatctagaccaaaggagagagactgctttagctataaattggacaatcagctctatgaaaatgatagtgttttagaaggatgagattacttaaggctaaggtgaccccgtgatttatcatctaaacaagaactcttgaaaatagaagggactgtcattaataattatactaggatagcaggctaatccaggactggccaaagcaaatcaggagacactgttgcctct

SEQ ID NO: 390351 - DNA, 312 bp, Homo sapiens
tgatgactgaagacagcatctctctttctgtttcaaaagacctagtaaagagtaatgagaaaaatttgagagggcccaggggatgcatatctatagatatttcacaccacactcaggcagcttattgtctttagttccagtaaaaatagaccattgggaacaaattcaaaatctgtggaatctggtgttaatgtgaagtgactcttgctcttgcaaagaaatatgctttagaactcttctctagaactcagatgttttatgaatggtgatgaggataatgaagctaataattataaataataatcctatgtg

SEQ ID NO: 390352 - DNA, 169 bp, Homo sapiens
cgttttaccccactttccatacttactcttgggaaggaagtcactatgcatggtccacacataaggagtggggagttatgtaacacctcgctgagggccaagtattgacatgaattatttggaatttcctgcatggggcatttgtctctgctctgataatttgtttagt

SEQ ID NO: 390353 - DNA, 3456 bp, Homo sapiens
agcgggagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaatctcttcccaaatctaaatttgataggggaggtggagattccaggggtgggtgaaagaagagatagaacttagcaggcagacttaaaaaaaaaaaaaaagttcatcatcataatctcaattttgtggctatgactcctaatcacgcttcctaagaagcaaaggaggacaaatattcatgtgctagatagcactgtggtgtggacttgaacttggattgaccttaaattttatattcctcaaataaaagagaggcagcgacaagatacctcattatcagatgcttggtttatacattttgggactaaaatacttggtgatgaaatgacatacacctttaaacttgttatggagatagtttaatgtaaaaccaactacggaaaaccctcaacttaaggatacagcttggaaattggaactgcaattgccttttattaaaaccatatggtgtgatgtttgtttttaaaattatataagactttatgctgtcacttctcttgctgtactgtaattcatgttttaaatgaatttgataatgaaattatactattatcattcttgatgaatacttttcttatttttatgatttttctaatgaaactttaaacttttgagatttgagagtctgttttctataagtagaattactgttgttacaaaatgaaaaaggactgacctaaaatcagtctcctcttttggtctgtgatggattttaatggccgttctgtgttcatgtatacctaagatgagattatattacatccaccaaagactcagtttgaagataaggaatgagtgatagaagaaataaggctgagatccttaaaagcctaattaatttaactcgcttaacccattagtactatctagtaccagaccccttttttttgctgaaattatggtatattttcaacttcactaattacaaattatctagatttagaactctatatgtcagcattgacctgggaatgaagtcaggatagagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcagtgtcccaatttcatcttagaaaaaggtaggtatggctgctttgtcggttgaaagttaaggggagccatgatctcccatatttaggaaaaagttatttaaaaaagagcagatggtggaaaaagaatgtaagacccagaatttatccctttgacaatgaatctggcctttttaatagcaggatggaattgattcactagtttttgctaactttcactttcagtaaaggttgaggtgttgtttttgca

SEQ ID NO: 390354 - DNA, 3646 bp, Homo sapiens
agcgggagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaatctcttcccaaatctaaatttgataggggaggtggagattccaggggtgggtgaaagaagagatagaacttagcaggcagacttaaaaaaaaaaaaaaagttcatcatcataatctcaattttgtggctatgactcctaatcacgcttcctaagaagcaaaggaggacaaatattcatgtgctagatagcactgtggtgtggacttgaacttggattgaccttaaattttatattcctcaaataaaagagaggcagcgacaagatacctcattatcagatgcttggtttatacattttgggactaaaatacttggtgatgaaatgacatacacctttaaacttgttatggagatagtttaatgtaaaaccaactacggaaaaccctcaacttaaggatacagcttggaaattggaactgcaattgccttttattaaaaccatatggtgtgatgtttgtttttaaaattatataagactttatgctgtcacttctcttgctgtactgtaattcatgttttaaatgaatttgataatgaaattatactattatcattcttgatgaatacttttcttatttttatgatttttctaatgaaactttaaacttttgagatttgagagtctgttttctataagtagaattactgttgttacaaaatgaaaaaggactgacctaaaatcagtctcctcttttggtctgtgatggattttaatggccgttctgtgttcatgtatacctaagatgagattatattacatccaccaaagactcagtttgaagataaggaatgagtgatagaagaaataaggctgagatccttaaaagcctaattaatttaactcgcttaacccattagtactatctagtaccagaccccttttttttgctgaaattatggtatattttcaacttcactaattacaaattatctagatttagaactctatatgtcagcattgacctgggaatgaagtcaggatagagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcagtgtcccaatttcatcttagaaaaaggtaggtatggctgctttgtcggttgaaagttaaggggagccatgatctcccatatttaggaaaaagttatttaaaaaagagcagatggtggaaaaagaatgtaagacccagaatttatccctttgacaatgaatctggcctttttaatagcaggatggaattgattcactagtttttgctaactttcactttcagtaaaggttgaggtgttgtttttgcaatgactgtgtattcattgaggaaaggtttccaatgaaatttcattactctgacctcttctaatttttggtcttctttatatttacatgtcttacattccacaaaattatttagaaatgctgggcatggtggctcatgcctgtaatcccagcactttgtgaggccgatgtgggtggatcacttgaggtcgggagtttgagaccagcctgaccaatatggagaaatcccatctctgctgggaatacaaaattagctgggcgtggtggcatgtgcacgcctgtaatccccgctactcgggaggctgtggcaggagaattgcctggacccaggaggcggaggttgcagtgagccgagattggccactgcactccagcctgggcgacagagtgagactctgtctca

SEQ ID NO: 390355 - DNA, 1584 bp, Homo sapiens
agcgggagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccagcctggctcacagttgccttactgtttcagcttaatggtcccctattctgttttgtcgctgctgccacacttaacttggaccatgtcgaacgtgtaccttcatgggttcttgctcagttcagatgttctaccacaaagacatctttctggttattctgtccatattgatctctttcttccctgtatttacctttctgtgtactttgtatatcagcatgtaatcctttctgtcctgtttattccaaattctttcccatggatataagacccttcacaatctttctgcagactaccattcagcctcagtacatttagctttttgtacggagtgctggaaacatgcgaaacc

SEQ ID NO: 390356 - DNA, 368 bp, Homo sapiens
tttctgttagttcctaatggaaactaatacacttaaagaacacatctatcctaataaatcttaattgttgttcttttggatttaggatgaatgggaaacaaaatacttttatgcaatatcgttttgatttcttacagattatgaagttagaaattgatgagattgcagcacctcgatcatttatttttctctggtgtggttctggggaggggttggaccttggaagagtggtaagatggtgcttttataaagtggatttttaaattaataagaaaaaaatgtaacagtatgttgcataggatgtttgaaagtggatgttattttgtcctttgtttcttaaataattctaaaatagtgagaaaaaaaaa

SEQ ID NO: 390357 - DNA, 3857 bp, Homo sapiens
agcgggagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaatctcttcccaaatctaaatttgataggggaggtggagattccaggggtgggtgaaagaagagatagaacttagcaggcagacttaaaaaaaaaaaaaaagttcatcatcataatctcaattttgtggctatgactcctaatcacgcttcctaagaagcaaaggaggacaaatattcatgtgctagatagcactgtggtgtggacttgaacttggattgaccttaaattttatattcctcaaataaaagagaggcagcgacaagatacctcattatcagatgcttggtttatacattttgggactaaaatacttggtgatgaaatgacatacacctttaaacttgttatggagatagtttaatgtaaaaccaactacggaaaaccctcaacttaaggatacagcttggaaattggaactgcaattgccttttattaaaaccatatggtgtgatgtttgtttttaaaattatataagactttatgctgtcacttctcttgctgtactgtaattcatgttttaaatgaatttgataatgaaattatactattatcattcttgatgaatacttttcttatttttatgatttttctaatgaaactttaaacttttgagatttgagagtctgttttctataagtagaattactgttgttacaaaatgaaaaaggactgacctaaaatcagtctcctcttttggtctgtgatggattttaatggccgttctgtgttcatgtatacctaagatgagattatattacatccaccaaagactcagtttgaagataaggaatgagtgatagaagaaataaggctgagatccttaaaagcctaattaatttaactcgcttaacccattagtactatctagtaccagaccccttttttttgctgaaattatggtatattttcaacttcactaattacaaattatctagatttagaactctatatgtcagcattgacctgggaatgaagtcaggatagagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcagtgtcccaatttcatcttagaaaaaggtaggtatggctgctttgtcggttgaaagttaaggggagccatgatctcccatatttaggaaaaagttatttaaaaaagagcagatggtggaaaaagaatgtaagacccagaatttatccctttgacaatgaatctggcctttttaatagcaggatggaattgattcactagtttttgctaactttcactttcagtaaaggttgaggtgttgtttttgcaatgactgtgtattcattgaggaaaggtttccaatgaaatttcattactctgacctcttctaatttttggtcttctttatatttacatgtcttacattccacaaaattatttagaaatgctgggcatggtggctcatgcctgtaatcccagcactttgtgaggccgatgtgggtggatcacttgaggtcgggagtttgagaccagcctgaccaatatggagaaatcccatctctgctgggaatacaaaattagctgggcgtggtggcatgtgcacgcctgtaatccccgctactcgggaggctgtggcaggagaattgcctggacccaggaggcggaggttgcagtgagccgagattggccactgcactccagcctgggcgacagagtgagactctgtctca

SEQ ID NO: 390358 - DNA, 3617 bp, Homo sapiens
agcgggagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaatctcttcccaaatctaaatttgataggggaggtggagattccaggggtgggtgaaagaagagatagaacttagcaggcagacttaaaaaaaaaaaaaaagttcatcatcataatctcaattttgtggctatgactcctaatcacgcttcctaagaagcaaaggaggacaaatattcatgtgctagatagcactgtggtgtggacttgaacttggattgaccttaaattttatattcctcaaataaaagagaggcagcgacaagatacctcattatcagatgcttggtttatacattttgggactaaaatacttggtgatgaaatgacatacacctttaaacttgttatggagatagtttaatgtaaaaccaactacggaaaaccctcaacttaaggatacagcttggaaattggaactgcaattgccttttattaaaaccatatggtgtgatgtttgtttttaaaattatataagactttatgctgtcacttctcttgctgtactgtaattcatgttttaaatgaatttgataatgaaattatactattatcattcttgatgaatacttttcttatttttatgatttttctaatgaaactttaaacttttgagatttgagagtctgttttctataagtagaattactgttgttacaaaatgaaaaaggactgacctaaaatcagtctcctcttttggtctgtgatggattttaatggccgttctgtgttcatgtatacctaagatgagattatattacatccaccaaagactcagtttgaagataaggaatgagtgatagaagaaataaggctgagatccttaaaagcctaattaatttaactcgcttaacccattagtactatctagtaccagaccccttttttttgctgaaattatggtatattttcaacttcactaattacaaattatctagatttagaactctatatgtcagcattgacctgggaatgaagtcaggatagagaaattccacttgcctgtgatgggtccttagaagtatcagctaaggagtgaccctgtcctatacacagggctctctattacgttccataccctgggcctacccaaggtgacattcctgctgtttacatggcataggcacctgtgagatcagtgtcccaatttcatcttagaaaaaggtaggtatggctgctttgtcggttgaaagttaaggggagccatgatctcccatatttaggaaaaagttatttaaaaaagagcagatggtggaaaaagaatgtaagacccagaatttatccctttgacaatgaatctggcctttttaatagcaggatggaattgattcactagtttttgctaactttcactttcagtaaaggttgaggtgttgtttttgcaatgactgtgtattcattgaggaaaggtttccaatgaaatttcattactctgacctcttctaatttttggtcttctttatatttacatgtcttacattccacaaaattatttagaaatgctgggcatggtggctcatgcctgtaatcccagcactttgtgaggccgatgtgggtggatcacttgaggtcgggagtttgagaccagcctgaccaatatggagaaatcccatctctgctgggaatacaaaattagctgggcgtggtggcatgtgcacgcctgtaatccccgctactcgggaggctgtggcaggagaattgcctggacccaggaggcggaggttgcagtgagccgagattggccactgcactccagcctgggcgacagagtgagactctgtctca

SEQ ID NO: 390359 - DNA, 1039 bp, Homo sapiens
agcgggagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtggtaagatggtgcttttataaagtggatttttaaattaataagaaaaaaatgtaacagtatgttgcataggatgtttgaaagtggatgttattttgtcctttgtttcttaaataattctaaaatagtgagaa

SEQ ID NO: 390360 - DNA, 471 bp, Homo sapiens
cagtgagccaattcgaggccctgtctaaaaaaaggggggaagggagggcagtaagagcaagataatgtgagaggcctgagaaacaacaaaggcccaggattgaaagaagacaactctgtcagcctggcaggaatgggaaactctaaacttgagtaaggcatttcaccttgctctgttcagtgtatcttgtttacaaattggaaatcttagttgagttaaaacactgcagtattcttcaaagtgttatccctggctacttgcaatgagtcactttgaatgcttgtggaaatgcttgggccaggcacagtggcttatgcctgtaatcccagcactttgggaggcactgttgggaggatcacttgagcctgggagtttgacgctgtgatgagctgtgatcaggtgactgcactccagcctgggcaacacagcaagactctgtctcctaaaagaaaaaaaaaaaaaaagtcgacg

SEQ ID NO: 390361 - DNA, 299 bp, Homo sapiens
tggatttcttaacctgctagtcagtcggttgtcctttgacaagcttgcagtatttcagtgctatggtagggacgcatggtttcttgcccttctccctgtattcttcagtaacttctacagcatttttttacccctaaaaatgcctcaaacctgccttaactttattctttatgggccgagctctctccttccttttgtaataagcttctgtttctattttctcacctactgttcccttctcaactttctgtctgaacttgaacattcttctcctcctgatcaatacctaagaatgcttt

SEQ ID NO: 390362 - DNA, 589 bp, Homo sapiens
  misc_feature (583)..(589): n is a, c, g, or t
gagccatggagaatcatttcccgatggaaataggactgagtcttaacgaatttccagatttccaacatttccctctgtattttagtaacctgattctatgtactttgcatttccctccttttttgaaaaggattgtctgtaatgactatctcaacctcactaaaaattgtgtgggtcagtgaattaacttgcttctttagcccaggggttggcaaaccttttctgtaaaaagccaaatagtaaatatttttagctttgtgcctgtttttgcatagtttaccaaataattttgctaccagagctatgcattttgctatgtcttgattcatttattgtattcctacttggaaattattcccttggcaatgcacaactgaacttttatactcatctctatatacgtgtgtatagacatatgtatttttctacatatgcctatatttttgtatatggatattttgggtagcaagctttgtaatgatttctcctagtctgttacatttattcctataatttttgttttattgattgcataaaaagtttttatttttcatgtaaaaataaaagttttcaatattgaaannnnnnn

SEQ ID NO: 390363 - DNA, 412 bp, Homo sapiens
aaagaaagaaaactggctgggcacagttggctcacacctgtaatcccagcactttgggaggccaaggcaggtggatcacttgagtccaggagtttgagatgagcctggacaacagagtgaaacactgtctctacaaaaagtacaaaaattagctggatatggtggcacgtgcctatagtctcagctactcagcaggctgaggtgagaggatcgcctgagcccaggagacgtaggctgcaataagctaagatcacaccactgcaccctaccctgggagacatagtgagatcctgtcttgaaaagagaaaagaaagggaaagcgaagggcagcaggagactgctgagtgggaaaacacagctctagtctttaagctcttctttaacctatttctctccgtggccttttcaagaa

SEQ ID NO: 390364 - DNA, 374 bp, Homo sapiens
gagggcagaccacacctgcagtctgtgtcgggcccctcactgccctggcatcactctggggctctgctgggactttcttgtttgttttaaaggaaagttgagtgtttcctgagtgtgcgtaaagccaatgtactacttaaactgagtatttataattctttcttttaagaaataaaacaataataaaataccataaaccttgctttaattattcacaggtgtcaacttgtaatcatcatggggaaagggccaatgagatgccttatttaaaaaaggcacttgcctgcttttctttgaagttttgctaaaatgcttcattataacatgttcttgtttataaataaattccagcctttcaaagattgcggtgtttg

SEQ ID NO: 390365 - DNA, 348 bp, Homo sapiens
gctcactgcaacctccacctcctgcgttcaagcgattctcttgcctcaacctcctgagtagccagaactacaggtgtgcgccactactaaaaatacaaaaaattagccaggcgtggtagctcacacctgtagtcccagctactcgagaggctgaggcaggaagatcacttgagcccaggaggttaaggctgcagtgagccatgattgtgccactgcactctagcctgaatgaataaataaccacctgcttaaaagttacaggataccattgattgcttgattgattgatgaaggaaagaataaatccaggtggtggtacattccacaggaaaattaagaaggactgtt

SEQ ID NO: 390366 - DNA, 713 bp, Homo sapiens
cttgcaggattaggaacatcatctggcctgaacagaaggtaaaattgctgtctgattttctttttagagaaacctgttagtgaagctggcgattcagttctttctggtatacatttaggacctgttaaatatatattctgcctcaaggggaaatcatattctaaaaagtaaacaattcataggcaattcttgtaccttgagaatccattaatggctttcagaaggcaaattttgttgtcaaggggacaggttatatgggcaacttgcttctattaatacttttctgggcagattaactaaatgaactaatatttaacttggtctaatagaatgttagccagaacagtgcctggtaacaacaacaataatactagctaacatttcttaagtggtcactatgtcccataactattatacatgtgttaactaatttaatcctcacaaaaatgcaatgaggtagctgttatttttactcccactttataaatgagaaaatatagtaatatagcatattttacatatatacagtaatattgtagcaggacgagctgcagacaaaacccctcagacaccgagttaaggaagggctttattcggctgggagcgtcggcaagactcacgtctccaacaactgagctccccaagtgagcaattcctgtcccttttaagggcttacaactctaagggggtccgcgtgagaggatcgtgatcga

SEQ ID NO: 390367 - DNA, 118 bp, Homo sapiens
gaggtgatagaccacaaataaaagaaaaccgcagatgcaccacgcatgtagagagacggagaggggcaggaatgttgtctgcctgccgccacctcatttttgaaggctgctaagccag

SEQ ID NO: 390368 - DNA, 318 bp, Homo sapiens
tcttggcgattttaatgctttggaaaagatctcatggttttatctccaaaggaggaaattaatttgatgccatggaaattagttttctagtcgtatgccttgaatgagtgaagaatttctttttcatggtggtactaaatttggggaaagctatagaaactttcatctggaagcttacacttttcctcttttttgaaaatttggtgagagacttggatattttattattttctgtaaaagagtgtaatttgttatacaggtctaatattgatccttttttggaagtatggaaagaatctgagtataaagcagaattac

SEQ ID NO: 390369 - DNA, 2415 bp, Homo sapiens
agcggagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgacttttta

SEQ ID NO: 390370 - DNA, 4793 bp, Homo sapiens
agcggagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaa

SEQ ID NO: 390371 - DNA, 4823 bp, Homo sapiens
agcggagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaaaaacagagactaccacacaaaacaaagggg

SEQ ID NO: 390372 - DNA, 1885 bp, Homo sapiens
cccacgcgtccggacccacgcgtccggaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaa

SEQ ID NO: 390373 - DNA, 1831 bp, Homo sapiens
gcctactactactaaattcgcggccgcgtcgacttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaa

SEQ ID NO: 390374 - DNA, 1866 bp, Homo sapiens
tgtttccctttgtcttttcaagcttattacatatctaatatactcttattatgtcttgcagcattcagttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaa

SEQ ID NO: 390375 - DNA, 1196 bp, Homo sapiens
  misc_feature (16)..(16): n is a, c, g, or t
  misc_feature (45)..(45): n is a, c, g, or t
cggttcggcctccgcnctgtgaaggcagagagccgctgccgccgntttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaa

SEQ ID NO: 390376 - DNA, 2070 bp, Homo sapiens
agcggagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcgggtgtcaccatag

SEQ ID NO: 390377 - DNA, 387 bp, Homo sapiens
cagtgaaatttgttggaaaacttaaaatttagagccgagagcagttgaatgggtaaagagaatatttcagtcttttctatggaaaggtatgaatagacttaatcagttctggttttaagtaattttcactggggatatggagttaaattatcttgtttgtttcctggagcatcctgttgaatttatattttgaaacaatttaatacctgcttgctttccagataacttggtggaaagtgaaagctatagctattaaaatgtttgatggatgattcttctaacaggacattcaagatgtgactcaccgatgttaatttgttcagtacaaaatcttttaccctctggcactggagatttcatggtgccatatcctactaccctgggtga

SEQ ID NO: 390378 - DNA, 648 bp, Homo sapiens
agcctggcctgctggaggttggctcttcccaagaaagtttttagaactcagaggaactgcatgaagtagtagtgagaacacttagccctgcattgcagaagttaactgatcctctcagcatcactgtgaggtaggtaagtaaatctgaacttgaaacctaaagtgcaaggctaaacaagttgcttaagtccttgcaggaggtatagcatcagaaggtgattcatacactgggatccctggcccccaggcttgtgctcagaaagatcctctgttctgttgaccgcttgatagaaaactggaatttgatttattaaatgtttgacatttttaatgaaaagaaattgattcagaaactttgtgaattttgctcactgttttgagaatctaaagaccctttttcttcttattttagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctccttta

SEQ ID NO: 390379 - DNA, 216 bp, Homo sapiens
  misc_feature (214)..(214): n is a, c, g, or t
gtatataggactccccactacagcagcagcagcagcagcagcagcagcagcagcaacaacaacaacaacaacatgtgacaagctggccagggaagcaagtagaaacactgagactgtgggaagaagctgttaaagcaaggaagaaagaagctgctaaccgtgtgcacaaacctccacggtctgctactcgcttgtagatgggggtaccgcagcnta

SEQ ID NO: 390380 - DNA, 4633 bp, Homo sapiens
agcggagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaa

SEQ ID NO: 390381 - DNA, 3769 bp, Homo sapiens
agcggagtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccagctattaaaatctttttttccacctgatggagaagtgtgaaaacaaatatttaatcctgggcttggcaatgtgtgcagtgaaatttgttggaaaacttaaaatttagagccgagagcagttgaatgggtaaagagaatatttcagtcttttctatggaaaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagaga

SEQ ID NO: 390382 - DNA, 446 bp, Homo sapiens
ggaggttgcagtgagccaagatcctgccattgcactccagcctggacaacagagcgagactccgtccccccttccccctccccccaaaaaagaatatgcaggatactgagtgaaaagtacccattggatttaggaatttacaggtcatttcaacacttagcagagcagttgtgtggtgggaaacaccatttagtggtttgaaaagtgaatgggtaagaagtgaagcaactaaataccagctgtcaaaaggacacgagattgagcttcatagaggatatggggatgagcaaggattgtttttgttttgtttctttacttttttggtattgtttttaaaagaaacagatttataaatgtttaaatactaatggataaaataaaagtgagagtttgcagagagaggagagagtctgatgttctagaagaggcggaaggaaagatgcaca

SEQ ID NO: 390383 - DNA, 1254 bp, Homo sapiens
ctaatctccagcctctctggggagtaggtgattatctttcattgagaaaccaattagagctgcccttcctcccctgagaccccctccctcgtccccctctcctagtcactccgtgagaatacgcgcgcgccaccccaccgacagccgagttgctagcagagggttggatcagagagcctggtcccactccatcacacaaaactcactcttccacgctatatggtaccaagggaagggggtggggtggggggggggagatttatgccacttgatccttgaaatagcaacaattaccatgtgatctggcggatgacgcagcgcttgtaactggatcctaaagagtgtgagtgtgtgtgtatgtgtgtgacatttcgtaaatattaaactgcctttagacagtaacctgcacaaattcatcttggtctttgacttttacttcttttctatttttgatgcctggatggattcagaaaggaaggcgtgtgtgtgtgtgtgtgtgcgtgtgtgtgtgttagttactttgaagtctcatggttctgaccctagtaagaatgacagggcaataccagttccaaggtttttcagcgtaaagccttactggacagagtgaactaaaattgttggtggggaagttggatgaacatagggtaatgagccaaatgattacggaaaagagaaaggccatgtgttaactgtaaactttttgtgtctggctttttttccatctactacccttcagtcttgtatacagagcatccaaattatatcacaatctcttcctcaatggctcagaagtggtggccaccagtgctaagctgggtcacactaccagttccagtttgggggagaaattgcatctttaattatctgtgtttaggtcttacctgtgcatccaccatctaccctatgctaaaaggattattctgcacagtagaataatcgcgtattcacggattcttacaatttccttttttatatctatgtatcacagagagcatttacataacataagtcactatttgagagtttgatttgatagggaatgagaagtatttcttctgataatagtcaacacattggtaatttttttaaggaaaaaaatagttgcaactaagataccaggagattctttcctaaattgtaacttttcttaaaaaagaaaaatcaatgtataattactggctacttacaaaaaaaaaattattctaccttttctgaaacaactaaataaaggaaaaacaggtgtatatttta

SEQ ID NO: 390384 - DNA, 590 bp, Homo sapiens
ctctgcctctgcgggctgggggaccttgcaggggttacataaccagtctgtggttcagctggctcaggtgtggaggaggacagcagtggtcccgacttcacagggttgctgtgaagattaaatggcacttggggccaggcacagtggctcacacctgtaatcccagcactttggaaggccaaggtgggtgtatcacttgaggtcaggagttcaagaccagcttgaccaacatggtaaaacctcatctctgctaaaaatacaatagccaggcatggtgccatgtgggtatagtcccagctactcaggaggctgaggcaggagaatcgcttgaacccaggaagtggatgttgcagtgagctaagactgtgccactacactccagcctgggtgacagagtgagactccatctcaatcattcaatcaatcaatggcacttagactggaaagtacctgcattgctgcctgatgggagcagaggtttgaaggacagcctctactgagcatcacactgttgtctttatagttgttgttataaaataatacgtcaagttccttgaacaccgtgcacagctgtaaaatactgaaagtaa

SEQ ID NO: 390385 - DNA, 323 bp, Homo sapiens
accatgttggccgggctattcttgaactcttgacctcaagtggtccacctgctttggcctcccaaagtgctgggattacaggcgtgactcccttctcttatcttactgctaggagaacctaggcttaaagagggagggagacttgcttaaggtcacacagcaagctaacagcaacaggctagaatagaccccagataactttccaggatacagggttttctgcaccacccagagctgcccaggatgagtaatgtccacagccactctttattgagccattgttaagctctagatgccttagtccttctggtcctcacaactaa

SEQ ID NO: 390386 - DNA, 963 bp, Homo sapiens
gggaggtttaagtctgcagaagtttctgctgccttttgttcagctatgccctgcccccagaggggagtctacagcaacaagcaggcctccttgagctgcagtgggctccacccagttcgagcttcccggccactttgtttacctactcaagcctcagcaatggcggatgcccctccctgagccttgctgccgccttgtagtttcatctcagactgctgtgctagcagtgggtgaggttccatgggtgtgggaccctccaagccaggcgcaggatataatctcctggtgtgttgtttgctaagactgttggaaaagcgcagtattagggtgggagtgtcctagttttccaggtaccatctgtcacagtttcccttagctaggaaagggaattccccgaccccttgcgcttcctgggtgaggtgatgacctgccctgcttcggctcatgctctgtgggctgcgcccactgtacgacaaatcccagtgagatgaacccggtacctcagctggaaatgcagaaatcacccgtcttctgtgtcactcatgctgggacctgtagactggagttgttcctattcagccatcttggaacccttgggcagatcattgtatattttctaataccacacatgaaatggctaaacaattatttaattgtggattccaagaataacctgacccttttcattcataatgctatacatagagtacacagactgaaagacaagtggctggacacggtggctcacgcctgtaatcccaacactgggaggccaaggtgggtggatcacaaggtcaggagtttaagaccagcctggccaagatggtgaaacctcatctctactaaaagtacaaaagaaaattagccgggtgcagttgcgggcacctgtaaacccagctactcgggaggctgaggcaggagaatcacttgaaccccgggggcagaggttgcagggagcagaga

SEQ ID NO: 390387 - DNA, 409 bp, Homo sapiens
tgaatgtggccgctgtgcggatacgccccccatggtgaatgtggctgctgtgcggataggccctccttggtgaatgtggctgctgtgcagttatgccctgcatagtgaatatgggtgctgtgtggatacaccctccatggtgaatgtggctgctttcagactcagccccacctcatttgggccctgggagttggtggttcaccttgtgatcccagacagcatcagagatgggaaaagagcctgttgcctcagtgagcactacattcctgaaggaatgaaccgtctttgaagggaaacacttaacgttttcaaagaagtcctttgagctttctaagaaatgaaccttcttttcttccatggcttttccctctgggactttgaaatcttttccaacatgagctcagcaaaa

SEQ ID NO: 390388 - DNA, 732 bp, Homo sapiens
gtctttccagccgccctgtggggaaggtgtcttgcttccccttcaccttccaccatcagtgtaagtttcctgaggattccccagccgtgctgaactagatgtggtctcactgtgttgcctaggctagtctcaaactcctggcctcaaactatcatcccaccttagcctcccaaagtgccgggatcacagatttgtcccatagcataagattcacactcaatactatcatcctttgggtctctaagacaccaacctaaaagcagaagaaggcttcaaaggtggaagaagatgtgagcctgggtgattgaaaaatagatgtgccattaccctgaaataggacttcttcaaggcaaaggctgatacagtggtggctacagtctatgttgtgatttgatggaacttttcacttttcaccattcaaaccagtatccagaggtacagttgctgcataacttcctcattatccataggaccaaactaaatgtctctggtttgaaattttgactagaaattatatacatctgccagcaattattgtgggtgtaactgaagtgcacactgctcactgcccctcaataacatcattttcaaataataacattggaaagaggtactttcctaaaactttcaagtgatctacaatctcccagactacttttacaatggattttttttttttttactagatgtgttatttcaattttggccgctaaccaaaaggcaggacattgc

SEQ ID NO: 390389 - DNA, 118 bp, Homo sapiens
ctgcctcagtctcctgagtagctaggactataggtgcgcaccaccacacccagccaatgttttaaattttttgtagagatgggatctcgctttattacctgggctggtctcgaattcc

SEQ ID NO: 390390 - DNA, 393 bp, Homo sapiens
atttcccccaaattataattctcagggagaaagggttagggaaataaatttagagagaagagtggcagatgggacagatggattcaattaaggcaaagaacatcaaataattccagggatgcctcattctaatggaacatgtcattttctcctcattgcctccaggtaactcccaacagtctaggtaggaagtagggtgctcacaccgtgcctcaaccacggcaggagtttaatatcctcaaatgagagagctaacattccctcttctcttcttttcagtaatgtggtgaaacagcacatgaatcagactaagtgaatgcaggatacataatagatgcacatttctacagaaccaggtgttattcaagttaaataggtattttccattgtcat

SEQ ID NO: 390391 - DNA, 188 bp, Homo sapiens
tttctttcattctttgaacacatttataatgatgttttgaagtctattactgttaaatctgacatctgtttacgctcataggcagtttttgttgcctgccatttttttttttttttttttgcacatctcattatatatttcttgtgatctttggaaagtgaacattttacagaatacattatagcaac

SEQ ID NO: 390392 - DNA, 868 bp, Homo sapiens
tttgtgttgggccgcattcaaagctgtcctgggccacgtacaggctgtgagttggacaagcttgatctaaattaatgaagattattttgtctttcaaaatgatttttgcgccatcacaattaacagctaagtctcatctttttatacattagggctgattatttctattttgtgaaacaagattttaatccttaattcactaaaaatgcttgcccttcctataatagtgtaaaaagaccagttgatttttgtgcatgaaaattatgagctaggtataacaacatcgtgtgtttggtgcctactcatccctaacaaacaatgttcagctctcagtctacttctctgcattgtatttataaaaaataaattgtggctcagaggttaagtaacttcccaagggaagctggaaagcaaagagcttgcataagaacccaagatggctagaccaccaatcttctggtagtcaccacagggaaagtttgatgaaatgatttaaaagattggaaaactatttgaaataaacgctcatttgcattgatagctacttttggaatatttttcttctaatcaagagtttaagaaatattgttaaaatgtatcttactgaggaaagtaacttgcaaaaaacagtacattgccaaaagcagtatacacattgcctaaccaacacttaacccagtgtctatgaacttcacattgcctcacgccatatggaatgtgttgattcattcactgttccgtttttatctacaattttggtttaacaaggctatgtatttaaaataatttttaaactctttacaggtaagtcacttttgagttgtaaaattccagaagtgacttttcttgaagtaggctttaatgaaaa

SEQ ID NO: 390393 - DNA, 246 bp, Homo sapiens
cgcacccacacgggtgagcgccctttctcctgcgactggctcgactgcgacaagaagtttacgcgttccgacgagctggcccgccactacaggacgcacacgggcgagaagcgcttctcctgccccctctgccccaagcagttctcccggagcgaccacctgaccaagcatgctcgccgccactcaccagcgaggtggaaagctccgcctccggctccggtcccggcccggcgcccagcttcacca

SEQ ID NO: 390394 - DNA, 660 bp, Homo sapiens
ccagaacttccaccccgactccgaggctgccatcaaccgccagatcaacctcgagctctatgcgtcctacgtgtacttgtccatggcctattacttctcccgggatgacgtggccttgaacaacttctccaggtatttccttcaccagtcccgggaggagaccgagcacgcggagaagctgatgaggctgcagaaccagcgaggaggccggatccgcctgcaggacatcaagaagccggaacaggacgactgggaaagcgggctgcatgccatggagtgtgctctactcttggaaaagaacgtgaaccagtcgttgctggaattgcacgctctagcctcagataaaggtgacccccatttgtgcgatttcctggaaacctactacctgaatgagcaggtgaagtctatcaaagaactaggtgaccacgtgcacaacttagtgaagatgggggccccggatgctggcctggcggagtacctttttgacacacatacccttggaaatgaaaacaagcagaactaagccacgagctgccttcctcccaggctagtggatccaaagaccaaagtcagctgtctcctgctttcttgcccttaaaatcacctccatctttatattcttctgttatactattcctccaataaagtgatttgtagaaa

SEQ ID NO: 390395 - DNA, 717 bp, Homo sapiens
gagcacctttataatccccacctagagacccgggtgggcagcccaaggagaacatggtggccgggcagggcccctctttgctggctctgccaccctcaacaggcagcttccgtcgggtgccctgcgggcagctgtaaatgatgtgcgtgcgcggggagtgcgtggaggagggaagtgcggggaggggaggaagtggggggcttcaagggccaccactgaagtcacatacaccgcttctgtttcatctcattggccagagttttagctagggctgcacctagcagagcttgggaaatgtttttagtcaggtgactctgccactcatgggtgttctattaataaggaacacctttcatcacaggccaggggttggaaatgtacagccttgggcctgtttttgcaaatgaggttctgacaggcggccacacccattcatttacgtatagtacgtggctgctttcatgcctccaggcccaggtgagtagttggaacagagactttctggcccacaaggcctaaaatacttcctctctgaggcaggggcgcggtggctcacgcctgtaatcccagcactttgggaggccgaggcaggcagatcacctgaggtcaggagtttgagaccagcctggccaatgtgatgaaactctgtctctactaaaaatacaaaaattaacctggcgtggtggcaggcgcctgtaatcccagctactcaggagg

SEQ ID NO: 390396 - DNA, 868 bp, Homo sapiens
cttagttgaaacctattattgaaaagtttgtaagctcttagaaggtggtaaatctatctccatttctctcaggcattatctgtcaaagttgaagtgagcttagcaaatatttttcctggagttaagttaaagtagaaaagttaaacttaaataagcttgagtattctccactaatctttatttctgttatttcctatttgacatttatctgttaacacacttctgtccatagtacacacagtagttgacagagccaagatattggaattgttttggctctgggatggtgagtgataagtaaattttccccctttttctttcaccttttatttgcaagcaactagttggcttatgtttcctttgaaggtgtagagttaagtactccagcattcactgggtcttctctgtggctgacccaaaggtctctgatcctttcttttgaaattggtgagattgttggtccactgggcatattgaaccatccacattgcttgctctttctaaattgtgctgtagcacctgagctttctaacttggtgttatttttgtctttctgcttagttatgtgtaatggaacagtatagttgacaaaggattatttagaaaattttcatctctcttaccccctattttgcagagtgtgagctggcgccatgtctaattcaacggtatggcagtagctgtttttataaacattttcctccctcttccattagtgtatatgtagtgaagttgactttttaaagtaaattgagcatttttagatttggaaggtggctcagcagtaatctaggcagcagcttcaagatcatttcaatgctatttgttggattggaattttcaggatgcttagatatatctctcatgt

SEQ ID NO: 390397 - DNA, 671 bp, Homo sapiens
agtacccactgatgttggaaattcaacttgttccaatattgaggactgcctatacctggcatatgcgtgtcccaatttgagaaattgtttttcaagttgacttgtatggattccttacagacgctcaagcatcagtttggttttccctaaatcctgcagatcaggaaggcagtatccatgtttgctttaagaaatttcattactataaatatatgaaatattataaatataaaaattcatatattataaatatatgaaattttgtctgcagaatttttttctcaacaggcaatcctgacataataaccaattttgagatgcttcaaaaataacactgcagtagtagccactcctaaaacaaaatatttcccctttccttcaatatatgtaatcacatatgacatataaaatctgcttattggataaatttatctttaaaagactatctatatttattaaaagttaaaatacatatactctttgacctggaatcaagtacaacaatgtattttacagagctaccagcacacgtgtggaattatatatgtacaaggctactaactgaagtattagtatagtaacaaaaattaaaaatcaaccataaatagggaataaataatggtacacctatgaatgaaatactaacttctaaaacacaaagtaaaaagaaa

SEQ ID NO: 390398 - DNA, 340 bp, Homo sapiens
aatttagccttctgatattgtagtatttaataagggtttctaaaaacatatttcccttcaagagttgggcaagtgccctcattatgataatctatggtattttcatctgatctgctgagatttctgtctttgtaaggatggaataattttcctcttactaagaaatctgtgtttatctacagatttctcctgtggctcaaagtttcaagtcattaaacttacaattgttaattcaataagtgttcactaatgccttctatatgattagcaccgtgctagatggtgaagatacaatgatgaatagtgcatttccccaaatcatgaggagtccagaggttgg

SEQ ID NO: 390399 - DNA, 481 bp, Homo sapiens
gtaaacctccatccaacaatgttgagtatctcattagtctccaaacaaaaagagattaaaatttgaaggtgattgattggtttcaggagtttgtatgtaattatcctatactcctgcctatgtgaaaatatgaattctagatctacatggaacagtatatatagtagccagtaaccatatatgactatttaaagaatgaggccaggcgcggtggctcacgcctgtaatcccagcacttgggaggctgaggcgggcggatcacgaggtcaggagatcgagaccatcctggctaacacggtgaaaccccgtctctactaaaaatacaaaaaattagccaggcatggtggtgcgcgcctatagtcccagctgctggggaggctgaggcaggagaatggtgtgaacccgggaggcggagcttgcagtgagccaagatcgtgccattgcactccagcctggacgacagagtgagactctattctca

SEQ ID NO: 390400 - DNA, 418 bp, Homo sapiens
tataagggtgccaagcctggccagcacaagcacacccaaaggcagttgccagctgtgcttcattggcagagcctttatcaccatccagaggtcactgagcaaaggaaaaacatggaaacacaccatcaggcggcatgtcttaaagcacccaattgtttttccagtgggcaccaaagaccagtgctcgcattgtttcctggtttaggctttctcagttttaactcagattatcatctattctcaggatcttgtgtatctcactgttagaatgtacagactatctcaccccagcccacagtgctgacctcaccttggctgtagggctcttccatggatgaatgttctccctaattagtcaaatacagatctctaaaaacctcaaactcacaattaagggacctcttttattagtggtcaa

SEQ ID NO: 390401 - DNA, 927 bp, Homo sapiens
actttgggaggctgaggccgacaggattacctgaggtcaggagttcaagaccagcctggccaacatggtgaaacctcatgttgtctctactaaaaatacaaaaattagctgggtgtgggggcaggcgcctgtaatccccggtactctggaggctgagccaggagaatcgcttgaacccggaggcagaggttgcagtgatccaagatcgtaccactgcactccagcatggggaacagagcgataatctgtctgaaaaaaaaaaatggaataatacaaaattatactaagattcattcatgttattttttgtggctgcagtgcattcatttccactatatagtatttcattgtctgatgtaccagaatttatccactctctttttgatgcatgtttggatttgcagtcttttgctttatgaaaagtgctgctgtaaaaattattattatctgtctcctgatgcatatgtgaaagggtttttctaggagtgaaattgctggataatatgtaaataataaacataagaaaatgtcaaattcttttccaaagtagttaatcaagttatactccaccagcagtgtataaggagttctcattgatccatatcttctccaacatttaggtttctcacagttttacatttttttgccagtgaaatgtacataaaatgtatcttatggtttaatctttgtttttttttaactcagtctttctgcttttattctttattctctattgaaaataatttggtttagatttagacttagattgataaaattaaaaaaaaaaagaatttgggctgggtgtgttggctcactcctgtcatctcagcactgggggagactcagatgggtgcatcacttgagctcaggagttcaagaccagcctgggcaacatggtgaaaacccatctttattaaaaaatacaaa

SEQ ID NO: 390402 - DNA, 542 bp, Homo sapiens
actcagtgctatgatgtcctccctggggtatcgaggctcgactactgtactcatcgtgtgagtcgctgaaaggctttgttatctactccatggtctctttgagaaaaaaggcctggtcccattaagctcttgcctcgtttttgcctttcagggattattcgtgctctgtgttagatgtgaacttttggttaggtacataggaaatatctacctaagacacttgtgatttccaccaagtttgaaacagcaatctaaaagctaactcattcattaaatgatggaattgttaagttggtataaagtgatggtacaaaagcccatcagggcaggtttgaaatctaaatgcctttcagtatgcattgaacatgcgcatccatgagaaaatagtatgataaagaaagcagggtgtgaccttattggattcatatttccttatagaacctccaaattaagacaaatttccagacatttctaaaagcagcaatacaatcaagaaaacaaaacaatgagattcagtatgtagctactgcaaatttgtcaga

SEQ ID NO: 390403 - DNA, 672 bp, Homo sapiens
gtagaaatgcagtttcaccatattgcccaggctggtctcaaactcctggggtcaagtgattcacctgcctcggccttccaaagtgctgggattatgggcatgagccattatgcccagcctaatttttattattgaagatgttacttctttttgtttttcctaagacttggcagtggtttcaggcatactttttagtacctccttaaagaaagaatccattatccaaaagggtggcttggaatagttggaaatgagtgtgctctaacctttaccttcaccttcatagaagagtgtggtgaattgaaaatcactctacaaatgtctttctgaaggactttcccaattagtgggacgtagtttataacaatacattggttccctcaggatcagcggttaatctgtctttttattgaagcaggaaacaaccaggacaagatgagctcataaagtatagagcactatctctagaggaaaaattaggagagaccaacagaaccatctaagatcatctaagaacgtaagatgtagtaggttattatcgtgcattattccacataatttactacttagctaagaatccaagcaggaactacaagctattattagaaaagcaagctaaatagtttgggatgaataacctcatatcccatgcattcacctcccattaagaga

SEQ ID NO: 390404 - DNA, 216 bp, Homo sapiens
gaggagttcctccagctgtacccttaagacctgcgcacatcgctgtttgtaagtcgtatctggataagtaaaaaagaaaaggaagcacaccaagcagagccgaagtgacaaactgaaacatatctgagcttccgggagccagggccacaccctggtcatcagccctgtgcttggagacccagactccacctgacccctatcctcaggcctttcatg

SEQ ID NO: 390405 - DNA, 148 bp, Homo sapiens
caaaacacttcgtgtaggtgctttggttaactgcatgggggcagcagagcgacatggagcgctcacaaagctatggagctggccgggcctgagttcacatcaaatacatacctctcacttagtagttgtgcgactttattttcattta

SEQ ID NO: 390406 - DNA, 201 bp, Homo sapiens
ctagctgtgactgcagatgcagaccatcacacccggctaatttttctatgtttttagtagagacggggtttcgctgtgttgcccaggctagtcttgaacgcctgagctcaagtgatccgcttagtactatggttttatttggtgctttctttgaaagaacattaatgaattctcttacattatcactcattttgtttttct

SEQ ID NO: 390407 - DNA, 228 bp, Homo sapiens
atggcaccagggagtgtgaagagaagaggatgaaggaagacttcactgattgctcctgctgctgcaagaagcacttgaggcagctggtgtgggagccccaaatcacccgtaagtgaaggcaggaagagcagggaccatctctagaccagcgcttagcaggcagtgcaggggagctctgggccaggaagctggggctttgaacattgtggggtttgatgatgagagagg

SEQ ID NO: 390408 - DNA, 327 bp, Homo sapiens
tcaggcatagagcccgtagagaagatgctcttgtccagctggagccagtctgcttactcccaggaatctttaaaaacatgcacaccataatgattttattttaaaacttaataaatctgcattattttccaatgattgatgtcgaaccaaggccctttccaagggagtgcttgcgtttgccacttggaagagccaaggacttttgaacatggattcattgcttggagccctctcttgtgtaaagcatgctcgtaatgtatcacttactgttaccactttggatttcttcaaagtagagcaaaacttaggtgtacttagaaatctgag

SEQ ID NO: 390409 - DNA, 380 bp, Homo sapiens
accacaaattgacattccttcttttagtacctggtatggtattacaggcttcattcacatatagaatgttttcattttaagttttttaaagttgaagaatcttgaatataaagaaacatttatccaaatgagagttgtactacacattggataaatatagtcgtcccttaactgagtccttactaattttattgtgtcactattgtgctgcaaaacccagatatgcaatgtaaggaataatttagaggcttaaaatggcttgacacaactatcattaaatacatctcttttaacaagtaaagggttgattttttgttgttgttgtttgttttttgagatggagtctgactctgtcgcccaggctggagtgcaggggtgtg

SEQ ID NO: 390410 - DNA, 343 bp, Homo sapiens
gggcattgtttatgggggttgcgtgagtaatagaattcctgatggagacaggagatgtggaaagagagaggtaagaggggatcgcgggggcagagcgaagtatgaaatacaaagagccagggcccagcctctctgctatgccagcagtgacattcgggctgggtgattgtggcagggactgtcctatgcattgcaggatgttgagcaacatccctgggccccacctgctaagatgccagtagcagtacccccactcctatagttatgacaaccaacaatccttccagatattgcccaatgtccctgggtaacatcacttggttgtaaactactgccttaaaga

SEQ ID NO: 390411 - DNA, 1463 bp, Homo sapiens
cggggagaggtgggctgggctgcaggtcctggcgttgtgctggatcatcgcgcccgtactctgaagttttctccgtggcgctccttgagaggggttcctcctgcatcttgagaatattttgcatttcggctcccttctcttctcgctgccatcggatgccccaaataggtcctgtcccctcggtgaatcagacttcggaaaccgcctcgcttcagggtcagagtccaagtacagatgagcttgaggattctgaatgcacgcccggctctagaccttacagacacacgcttggacagacttctccatatacgacccaggaacggaccccttgagaagggattcttcacgcccgctgccctctccagcgtcctggccagtggcatcgcgttcccaggaaacctcgcttcagatattgcccaccaccccgccctattcacggttcctgggtcttcctggaggaatgacatctcagagaatgcggactcctatgttcatgtcatttgagccgccgcgtcccttatttgatgtaccccttgttggtcccggaggatggcaactagacaaaaggtcacaggcccccacacccgctccataacggcttcttggctttttgtttcttttaagcaatgaggaaagagatgactttcgtgaaaacttttgctggagaagagatccttccctctgtatatgtgtgtgggatgggaagtgtcagactcagacctttagctccttgagatcaaaaaggtttcgtgtttgctttcgtctcttctttgcatccctagcgtctttaaaagagtaggcaggcgcggtggcacatgcctgtaatcccagcactttgggggtcgaggcgggagtatcacttgaacctaggagttggagaccaacctgggcaacatagtgagacctccatctctacaaaaaataagaaaattagcccggtgccagtggtcccagctagccggtaggctgaggtgggagaattgcttgagccaggaaggttgaggttgcagtgagctatgataacaccactgcactcctgcttgggtgacagagcaagaccctgtctaaaaactatatatatatacgtgtatatatatatatgtgtgtatatatatatacgtgtatatatgtgtgtatatatatacgtgtatatatatatgatgttttctattttattttatttttgcaccttttgtactcctcctggagttcatcctgacagacagaggtttgtctggagccagagctcacaaatagttggaactgccctaaggatgccattttgttcttaaatataactagcaaatattactcaaagctgtgcacgatccccaaaccctggtccccaataatttgaataatctgaatatgcaagttaaggtattgagatgggaaccctcctgtgtggtatatcttgctcttatcctttgtgaagccaataaacttcaatttctactctcata

SEQ ID NO: 390412 - DNA, 323 bp, Homo sapiens
accttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttccgccagtttcattgcctccgtagaacctagaaccgtgtgaaatgatctgaggcttcctccatgcactggttctgcccgtctccctccccacttccttctctgccatccccccaaggcctggcgagtagtaggtggtcagtaaacacctgttccgtgagtgccgggtgt

SEQ ID NO: 390413 - DNA, 481 bp, Homo sapiens
gtacttactctcatgctagaatttctgatgatgggagcaaacaatagtaaagaaaagaaattccttgcctaattatggagtggagaactgacgaactctatcacatcttgggactaatttcactgctctccaatgaatgcaaatgaaaaggggaatatcccccagggtagcattacagtaaatgaatacattcacattaacaagacagtgttgggatacttttatttgaaaggatataactccttacttatcctttaagaaagcatgtgtccgacaaaaaatgctatagcagactaagggaggtaattttaaaagagtactatctaccagataataaaagtgaagaaaggttttcaaatgactgttgccaaggagaaaactgaaaaagctgggaccaagagttccagtgcaggactgttcttgcaaattctgaccacattgtagctactttgcactattattccccaaatggaaaaggcac

SEQ ID NO: 390414 - DNA, 459 bp, Homo sapiens
gggcctgatcccatagattatgaagatgaagtcttagtgggatgagaagccattggagggtttggatcaggggaatgtcgtgaaatgatttccattttagaagattactgtcgctgctgcagaagagtggatggtaatggaatgacatggcagcagggagatttattaggaggctgtggtagtgatccagtccaaaacagtacagtagattatatgttaaaagcagaagcattgaaaatgcccagatttggagtctgttttcaaggtggaactgtcaggatttcctggtagagatacatctggattatatgagtcaggatcagtagtataaactttggaatcgtcagcatagaggtcaggtttaaagctgtgacactgaatgagcgcatctaagaattaaacatagctaaagaagcagtttcaggactgagccctgggacactataggttttagaagag

SEQ ID NO: 390415 - DNA, 248 bp, Homo sapiens
tgacttcacaccatttacatttactctcatcagcaacattattcagtacccagtatattttaatcagcaagtcattcaattaatagctatagatacagccaaaaggcacaaaatgcaataaaattcacctgcatgtcaaaggaacattccactttcacaaaaagtctatagcaacacatctggataaacctgcgtcatcacaatgtgaataacatgctgagttctgccaatatgcaggtttgcagatt

SEQ ID NO: 390416 - DNA, 337 bp, Homo sapiens
agcctagaaggtagggatacatcacatctagagtagcctcagtagtatttattaccaagtgatgccttcaagttgaagaatcccaatacaagagtcttggataaaatgagagattttgtatcccacattacaagagatttggggtggatggctccagaccaggttattcttgagcactcactgatggcagaactctagcttggtttccctgtggtctcatggccttcttttcatgactacaaaaagatgaatgttgcttcaattttcaggccatcacacaaccttctggagaggaagacaaagaaactatatcttcctggtgcctctttttatcagg

SEQ ID NO: 390417 - DNA, 212 bp, Homo sapiens
tggcatggtgccctcctaggtcatggttgtccctccttgttgttcctgctgtcttcttcagttacatctgcttctctgcatttcctcattttacagtgtgtgggacgcagtcatctctgaacaggaataggcaactgtgcacctgttacaccgtgcttgatgctctgcattgatgtacactgggcccaggtttccctggtggactgcttggg

SEQ ID NO: 390418 - DNA, 1127 bp, Homo sapiens
tggggtagagccccggaaggggggccatgggggaaacctctgcccgggggggttggggtgggagcctggagatagcgctcctggagagggcagagtaggggaaagctgtgcccaggggcagggacgggagcttggaggtagagccccgggagaggacagagtgggggaaacctctgcctagggtgctgggacgcgagcctggaggcagagccccgggagggtactgcgtggaggaaacatctgcccacaggttctggggcgggagcccgggacgcggagggccgcgagccgagggaacctgggggtggggaggagggggatgcggtaggggaggtgctcctgggtccgcgcgggtggcgggtgccgcgcacttatccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggaggttaagtctggatacaagcattccatatggaggttcacatcaggggcccaactccttctggcctgttcctgggctatgttcttggtccaagacggctgcttccacaccagtgattacatccatattcctgccagccaggagaaaaggggaaggggggacatgccctgaagttgcattcaccacttccgctgacctgcctccaagggaggctgagaaacatagcctctactctgagtgttcatttagggttctattcctatagaagaaggaagaatggatattgggggttcactagtagtatctgctccactaccattttttttaaaaaagcatttaaaaggagccatgtttggaatttattctacagatatgtatgcacaagtgattaaagatgtgtgtacaggaatatttattgcagcattgtttacaatagcaaaagactggaatcaatcataatgtccattggaaagggttggttatgtaaactataatacaaccagggaatgggataatgggatactagac

SEQ ID NO: 390419 - DNA, 996 bp, Homo sapiens
tggggtagagccccggaaggggggccatgggggaaacctctgcccgggggggttggggtgggagcctggagatagcgctcctggagagggcagagtaggggaaagctgtgcccaggggcagggacgggagcttggaggtagagccccgggagaggacagagtgggggaaacctctgcctagggtgctgggacgcgagcctggaggcagagccccgggagggtactgcgtggaggaaacatctgcccacaggttctggggcgggagcccgggacgcggagggccgcgagccgagggaacctgggggtggggaggagggggatgcggtaggggaggtgctcctgggtccgcgcgggtggcgggtgccgcgcacttatccgttggccagctgcgttccgggatcagctaccagacggtccctgagatgaccgggaaccgggctgggggaggatagagccgagactggaggatcgattggcacctccgcccacttttcccacaacgccttcccgaacgataggttggaaaggctcctggatccaaactcgctgagggccaggcaagaaaatgtcctcaaatttattgccaacactgaattctggaggtaaagtaaaagatggctcaaccaaagaggacaggccttataagatctttttcagagatctctttcttgtcaaagaaaatgaaatggcagcaaaggaaacggaaaaatttatgaaccgtaacatgaaagtctaccagaaaactactttttcatccagaatgaagagtcattcatacctgagccaactagctttctaccctaaaaggagtggtaggtcatttgaaaagtttgggccaggtcctgctccgattcctagattaatagaaggttccgacacaaaaaggactgtccatgaatttattaatgaccagagagacaggtttctgctcgagtatgctttgtcaaccaaaagaaacacaatcaaaaagtttgaaaaagacatagcaatgaggga

SEQ ID NO: 390420 - DNA, 511 bp, Homo sapiens
tgcagccagagcttgtctgaggcctctgctgcttacttgaatcctggttgctcttcacatcttgatgagcttctcttttttagtctaataggtataaaaagcatgttgttgttgtttatttaagacagagtcccactctgtctcccaggctggaggctggagtacagtggcttgatcttggctcactgcagcctctgcctcccgggttcaagtgattctccttcctcaacctcctgagtagctgggactataggcacccatcaccatgcccagctaatttttgtatttttagtagagacggggtttcaccatgttggccaggctggtctcaaactcccaacctcaggtgatccgcctgccttggaaacagtatctttttaattgaatagttttcttatgaccaaaggaatgtattatgttaagtgaaagaagggaagaaaaggaggaggaaaagataaaattgaaaaaacaaccctttctttctacccagaaataatcccttgtaaacatc

SEQ ID NO: 390421 - DNA, 349 bp, Homo sapiens
gaatgcggagtttactgttgaatggaaaactgggatggcattgccattgcatatatccaggctttggtgctgctattctaagcagagggcctggtgaaagagtgatgttctcctttggtactgtttggtcttagtgttctttggagtctggggaggtttcacctttaaaaatcaaactgctagggccaggtgcagtggctcatgcctgtaatcccagcactttgggaggccgaggcaggtggatcactaggtcaggaaatcaagaccatcctggccaacgtggtgaaaccccatctctactaaactccatctctactaaaaatacaaaaaattagccaggcgtggtggt

SEQ ID NO: 390422 - DNA, 147 bp, Homo sapiens
tgtacagttgttggagtgaatggccacaggtgttttaatgtggaaccagggagtcattgccatatatacttgccacaatgttgcaggactcttcccttggaacccagcctctccttcagtcccgacgttctgtatctgaaaactggg

SEQ ID NO: 390423 - DNA, 560 bp, Homo sapiens
gctgtgtcaccagacggtgctcccagaggctcccctgcctgagtcacaacccgcctccccagcggtaaagagcgagggagttagaccacctccttctgcatcccagctcccccgctccctggtgtacgaccctgacattgctaacctccctggacctccgtttctcttcttcataatggacgttagtgacggtacctatgctgtaagcctgccaaaagaccaaagtgagcacattaatccatttaattcatgttttccaagtccttcaatgctggcccacctcactggagcaaaagctcaggttcttccgttggcccaagcagccctacgtgacaggtttccttttgcctcagctccttctcgttcacccgtgtcttgtcattttcctctctcacctcatctccttctcagcacctcactcattctgtttcagccgcccggccttcctgctggttcttgaacatatatgatgcctccaggcctttgcacttactattccccctgcctggaatgctcttcccacagatacccacaaggcttttcccccagtcgcaagtctt

SEQ ID NO: 390424 - DNA, 267 bp, Homo sapiens
agtagagatggggtttcaccgtgtaagccaggatggtctcgatctcctcacctcatgatccacccgccttggcctcccaaagtgctgggattacaggtgtgagccactgtacccggccccaaggtgtccttaaaatttttttattatgtaaaagttgaaacatatacagaaataaaagtgtaatgagcctctatgtacccatcacctggctgtagctgttagtacctcttggccagtcttgcttcatctgtatcccgtcccacccat

SEQ ID NO: 390425 - DNA, 322 bp, Homo sapiens
ttccattatctgatgttctctggtcatagtacaccagaatataaagaagtggctaaagatgaagttagaaaaactggagttatagaagtatcaagagcttgacagtgagaaatactgaaaagatgggacaaaaggtgccattaactttacactacacaaaagttagagttcaaacatgagaagagtgatagatgtgaatatctagtccttaattgttcttcttggaaatggtacaactgtctaggagatggaaagctgcttgatgtagtgaaaggttgagagtaagaagcttactacaatctcagctctggtaatggtctta

SEQ ID NO: 390426 - DNA, 543 bp, Homo sapiens
atgagcaccaatgatgcatttcccatggcactgttgcccctccctcacagtgaccccgattctcttccctgcatcctccccatcctccattccatgtttccccaactccatctgcttccttgtaaccaacgcatggcccacgatgagcaccagaatggaggaaatagctcgcccttcccctctcgctgctgtgtgtgtccagctcagacccgggctccttagagtatctgccaggagcagggccttaggggaccaagagcttgctgtgaaacctgaaaagctcaaaccagcagcccccttacagttggttgggaagccctcatccttacttaaaagctggtgccactgttcatagctcagggattgtacgtgcttcccccaggccaggaaaggactgaaaaagagctgggcccagtgggtatgagcggggctcagcatggcgctcacatcaaccaccactcccagatacactggaggaggacacagcaggccaccagctctgggacaagggctaccagctgagacatgctcgtactctcactc

SEQ ID NO: 390427 - DNA, 815 bp, Homo sapiens
tgggagtgagggaggcacaggagatgaagcttttgggtaagaaagaagcatcatagactagaaattcataaacctgggttctaaaattctggatttgccatttcctagtcatggactctcagttaaaaccttttacttctctgggcctctgtttataatgttagaaaattttaaaaaatgcattagaatatgcagttaggaacaaagactctggagtctggtttccctttgcttaccagctgcgtgagccagggcaagttacttaaccactctgtgctttagtttcttcatgtgtaatacagggatactaatagtacacaggctgtagtgaggattacatacatgagtgtgtgcccagtgcttgggacattgctggccacatggtccacagttcacaagtgatagcagtgatgaggacgagggtgcaaacgctggagatgatgcagaggatggatcatcatcatcctcaccactgacatcatcacctccttcctctctggcagtctcagtttgtttcccgattaagtcacagaaatgaccactagcaagaaagaaacattctcctttaaaatactatacttaggggttgggcgcagtggctcacgcctgtaatcccagcactttggaggccgaggcaggccgatcatttgaggtcagtagttcaagaccagcctggccaacttggcgaaactctgtctctactaaaaatataaaattaaccaggcgtggtggcgggcgcctgtaatcccaggtactcaggaggctgaggctggggaatcactggaactcaggaggcagaggttgcagtgagccaa

SEQ ID NO: 390428 - DNA, 741 bp, Homo sapiens
attggcatgtgctttgagcctgagattataggtcaagttataaattatggagtacttggttttgaggttaaggtacaagtaagccttaggttcaaagttcactaattatttgaaaatttcagttgaaccacacagtgatcacattgctaaatccattggtcagtcaattctcagccctcctcttggcctgccagcagcattcaacccagctgatcactgtacctcctgaaactttttcctttcttgacttccaggacaccacattctagctgttcctgctcactgattcttcatctcccaactcctaatttatgctgaagttaccctgaacttatttcttggacctcatctcttttctgtctgcactctttcccttggtgagctcatccactcacctttaaataccatctatgtgctgtgattctcaaattttcatctctatgccagactcttccaggttcatataaccactgcctacctagcatctctcctgggatgtccagtcatctcaaacctagcatgtctaactaggcctcattcttagatccagagttttactcatctaagctaatggcaactacatttttatagttgttcacaccccaaatccaggagccattctgaattcttcatgttttttcacatcatacatctgatttatcctcaaacttgtcagctctaccttcaaaatatgtcctgtatcatagatagaagactcacttcccagggatctgtgtgact

SEQ ID NO: 390429 - DNA, 578 bp, Homo sapiens
actatatgccaggtaatgtgcccttcttatgcaatccttccaaccactcaatgaggtagatactattattaattttccctagcttacagatgaggaaacatgcttaacgggattaggtaatatgcccgatgtaacaagccacagcaaataaactgaggagtcagcatttgaatcaggcttaactttagagactatgttcctgatctctgatgttatattgttgctcagagtagagacttttgagcacagatgagctgataccaggaaatgagaatttattataaagaaagaaaaggagagaaggctagggagaaaggaggagacatgcatcagtacattctcctcctgcagatgtcacacctaacgtatgacagatgacagtacagtttctgcttaattcctgaacatgtcaagaaaggatctgtttgcttctttggtaacgtgttccaggtttcattctctatgcaccaaaaatatctacgaatagctcttgcaccctcttgccggtgagagaagacacatacagtcgactctcacagttcacagtagttatgttcgataaagatgctgtgaaccct

SEQ ID NO: 390430 - DNA, 426 bp, Homo sapiens
tgtcctgccgcagagcatttgaattgttcttccctgccttgaatgctctccccatgcccctaggtctagtcagcccattcgagattggcattcattcaacagctgtcaactgggcacccactgcgtgcttgatcatgtgtttagtgggatccttatgggatgaatgtcttcctccaacacacacacacgtgtgcgcgcgcgcgcacacacacacacacactggcgccaagtcccatgtgtttttccagggttaagctgaccttagtcctctaccacccaccaaccagccccaaatgcaaccgtcataggaaaaatgcaagagcagaagacataagaagaagggacagggaaaggagaaaaaagaaagaaaagataaatatttttaaaaataaaggaaaaaagaaaaaggaatggaatgagagaaag

SEQ ID NO: 390431 - DNA, 367 bp, Homo sapiens
  misc_feature (349)..(349): n is a, c, g, or t
ccagcaaggaagtaggaaatgtggaactgaaaaagaagttagaactaaagatgtggatctgtctttggcataaagattatattaagttacttgagagtagatgagtttccaaagaagcagtgtagcaagaatagtggagggccaagactggttcctgggggtcagcaacatctaggagccagaaaaaatgccttcggtgaaagaaacggaaagatgggtctattcaaattgtagtcagccaacccatgccagaagtaagcacagaaagtaagagtgaacattggccaagcaaagtgctgggattacagacgtggagccaccatgccctggcaggaaaacacacttttgnaatgttgtgttgacctgg

SEQ ID NO: 390432 - DNA, 267 bp, Homo sapiens
tgatgtcagacttttgaaaacaccattttccggcccccaaactactagtgtctattccctaccaattcctcgttctgttgccctgcctggctttcagggctatctgcttggaggctgagttggtcatgtcagtcctcagctcatgtctacttggttctttgttcttactgacggggaatggacgcctctaactgcaacacggttctgtccaaagcatctccccagcaactgcttctaccttggctcacaattctttttttttttttt

SEQ ID NO: 390433 - DNA, 103 bp, Homo sapiens
tgttttgttgcttgttttattatgacctcagattaaattgggaaatattggcccttttgaataattgtcccaaatattacattcaaataaaagtgcaatggag

SEQ ID NO: 390434 - DNA, 423 bp, Homo sapiens
ccttgtccttgtcgctaactcttaactgctttgcttctttttttattgttttcttttgtgtgttcctgtttgtttgtgttgctgtttggcctctgggcctcgggctccgggtaggatgaacttttagatcttcagttgcaaagaaacctagagtatttggatcagcaggtaggcagagctggtgccccccttatcatcccactgccttcctgtcgcatctctccactcctccccacctcctcatcttccagccatttgacaacctttgttggtgcaagcaggacacaacaaagtggcttatgttttggtttgcgcctacacaccccttctgcgtcttctccccttctgtcgtcttctcgagaagacgacagaagggtaaattctggggaggtctggaccatagaggacatttaggatgactgg

SEQ ID NO: 390435 - DNA, 836 bp, Homo sapiens
acataataggaggctgttgcactaatacaggtgaaaggtgatatttgtctagactagggtgggaacaagggggatggaaaaaatcgaatgattaggaaaatatttaggcctgtgaacaagagtgatacttttttttttcttttttttttgatacggagtctcattctgttgccccggctggagtgcagtggcgcaacctcagctcactgcaacctctgactccctggttcaagcgattctcctgcctcagcctcccgagtagctgggattacaggcatgcaccaccacatcgggctaatttttgtatttttagtagagacagcgtttctccttgttggccaggatggtctcgatctcctggcctcatgatctgcccgtcttggcctcccacagtgctgagattacaggcatgagcaaccgtgcctgcccacaggagtgatacaaaaaaaaaaaaaacaaaaaaaaaaaaaaaacttttggggaaaagaggccaaaaaaaggtgtgagacaacaataggagagagaggcggggagaccacagaaggaaaaaaacgtgggcaacagcgcggacacacaggaaaaccgggggacaagaacacggcaagacaatcaccccagataaaaaagcacacggggagaaccacagagtgtttgagaaacaaaacacacagagggagagccaggaggagaacagaggagggacacaacaaccgggggcctcgaagaggagagcgcgaatgcaaaataaggcccgaatagtgagaaaaagggagggaaagcggaaagacacacaagaaacaaacaagagaaacagacgaagccaacagagacacaag

SEQ ID NO: 390436 - DNA, 142 bp, Homo sapiens
ggtgggaggatcgcttgagcccaggaagtagaggctgcagtgagccaagatcgtaccactgcactccagcctggacaacagagtgagaccctgtcccccaaccccacaagaaatgggatcctactctagggactattctgta

SEQ ID NO: 390437 - DNA, 559 bp, Homo sapiens
accgccggccaggcacacatgtgcatgggcaagacccgcaggggacgtgtccctgggaagaatgcttcctttggttgaaggctgtaaactcgccctgtgaggtgagacatgtcagctcccagaaaaggtcccagcctctcatgattcacgccagcacaggcagcacagcagcagagcgtgacctcctagatggcagcgtgacctcctagatggcagcgtgacctcctagatggcagctgagctcaattccacacggctcagtcctggagacaatcactcactgcaacacgcattcctcatgggggcctcttcaggagccacgggcatggggcttccctgacctctgcactcacggtgggggcgcgcacagcaggggtagacactggcccgccatatctggagctgaagtagagcccgtcttgggctcgcttagcggagaccataggtggaggtgagccagtggcctcaggcatctgcagaacccacgcacacattgactttcgcacccgcctccatctccgtggacttgactgtgtcgtgcaaaacccactccacgtgc

SEQ ID NO: 390438 - DNA, 170 bp, Homo sapiens
actctagtttgtggaagatctagaatattgtagcagtcattcatttaatatgtagtatattgacaggctctaaaaaaaagttgatggtgagtatacttgggagagccttaagtacacaacaggacaagaaaggaatcattctagggtcagcgttaggctacagcttttgg

SEQ ID NO: 390439 - DNA, 570 bp, Homo sapiens
ttctgctgtgtgctttgtattgagatgcagagatgaataacacatgctttaaagtttataatctggtagggagacaaacgtgttaatcagtaatcatagtaaggtctaatttataatacgttaatatcaacaatacattgtaatagagctgtggcatacctggtatgccaaaagtgctaaaggggcacagagagggattacctatcatatttaaaaaacaaaaatatctttttgtcttatatttatttcttttatttttttttcttatttttaagagacagggtcttactctatcaccctaaggctggtgtgcagtggtatgatcatagcccactgtaaccttgaactcttgagctcaaggggtcatcccatctcagcctcctgagtaggtgggactataggtgtgtactatgcttggttaattaaaatctgtgtgtgtgtgtgtgtgtgtgtgtgtgtgtagagataaggtctcgctgtgtttattagcaggctggtgttgaacttctggcctcaagcgatcctcgtaccttggcctcccaaagtgctgggattacagttgtgagccac

SEQ ID NO: 390440 - DNA, 385 bp, Homo sapiens
taggcttctggggcagtacagaggagtctaagtgagaggcaggcctccctgggagctgggcccaggctctctgcagccatgcctttaaggagtgcctacggggtagcacgatcagatggacaggccagggctgcccagagctgggggtgggagcaaggtaagcagagaggtgagggaaggagggtgctggcttagcaggagctgaatgaatgggcctggaggggaaaagctaagggggatggggtggcttgagtggagtaggtgaggcctaggtgaaggggagctgtggaccttccaggacggacggatgtgagcagtcctgagtggggactggagttagggtggggaagggaagccccaggcagcccctgcaggcccctgcccc

SEQ ID NO: 390441 - DNA, 582 bp, Homo sapiens
gcagtgatggatgtggattatggatgtgggattattaaacagataattatctcattatatcaaacaacagtcatgaatatatacccgaggaccgcgtgcacctacaataaatgcaaaaagggtggtaggagtgggggcagttctattctcaaagaaaggagacaaaagtggaatgggacagggaagcccatttaagatttagctggagaacctggactgccagttccgtctctccacccacactgagcatcgtcacctggggcctgggtatcgcgacgatgctcacccttccgatgtcctgtgttggcccggctcttccaggtggaaatcagagatggtcagctttttggagagacaggtccagagcccacaccatgcctcttgtggtctggacaccactggtccacacaggtactgactctgtcttttctagtacggctgcaaccaagggcccacccactgaacggcttcagaacctgaagcttattctttcacagcagtggggactgcagtccaagatcagggtgcctgcagggcatgctatctggaaaggccctaggggagagtctgttccatgcctgg

SEQ ID NO: 390442 - DNA, 428 bp, Homo sapiens
gggattaaaggcatgagccaccgcacccggcctgtctgatttcatagaaatgaaaaattttgtttgaccaaaatcaacctgagcaatgttaaaaagaaaaatgacatttagggagaaaatgttttttgcgtatataaccagagattaataacaagtctatttgaagacttctgtaaatcaccaagaaactcataatccaccccatagaaaatggtaaaccatatgaacagataaagaggaagaagtttaaatgacaaatacgctaaactgccaatctgaccattaatcagggaagtgcagattgaaaaaaggtgtcatttcctggctaattttgcagtaacaagaggaggtgaatcgtcccaggagctggggaggaacctctgctctaggtagggggacaggaggtggcaccacccacacacactgtc

SEQ ID NO: 390443 - DNA, 324 bp, Homo sapiens
cccctgtgaggcagcagctaagttaacgggcctaatttagcattttcttctccttggcgggtggagagcggggagtgtaaacctggccattctgctacataaacttgaacaacacagggtgccaagccctgtcccagacttgctggttttgagcttccaggaatggggttccggcatctgtattcttactaaagcaccccatcctccaaaccagccttggaaacgctggcttaaggataattccaaaatggattattcattcaaaaggtttcaggggagatttgaggttgaatggtgagcaaccgacttgatttgcatgagggt

SEQ ID NO: 390444 - DNA, 345 bp, Homo sapiens
tgttgctcagcctggtcttgaactcctgtcctcaagtgatcctcctgcctcagcctcccaaagtgctacatgaatagattaataagactggaaaatactaggtatgcaacaattcttctttattgaatgggtgaatacttcctgggtgaatacttccttaagaaagtaagtctaggccgggcacggtggctcacgcctgtaatcccagcactttgggaggccgaggtgggcggatcacgaggtcaggagatcgagaccatcctggctaacacggtgaaaccccgtctctactaaaaatacaaaaaattagctgggcgtggtggcgggcgcctgtggtcccagcta

SEQ ID NO: 390445 - DNA, 335 bp, Homo sapiens
ttggggttgaaagaaggttgacaggtggaggttgttagtgggaggatgctaactgaaaatgctttataaactacatgccttttccaagctgttgtggttcttctgtccagcctgccaccccttgactgtgtgtaaggtgattcttctgaccagtctactgctgcggtactctctgcgctgtatgtaagcctccagtaaaaccccgtgttttgtttgctggctctgggtcttgtttttggcctcttgaacttggtgccattccccttggagtcaataggggtccggcacaagaacctgcactttaccaaccccagaattttaccccgagtgtaatt

SEQ ID NO: 390446 - DNA, 419 bp, Homo sapiens
gtaaggattaaaagagataatggacaaaaagccctaaacgcaggaactgtaacttggtacacgctccacatgaaggagagagcttcccatcaccagaggtaatcaagcatggtgaatccggttttcacaaaacttgcagtcttacccttcccttcactgtcccctgaacccaagacttagcccataccctccttataccataaaacctatgatacatatacaccacccttccaaacgacaaatcttcttttgtcggggatggggctactctagtcccttcctcctggtgggcctcagtttcccataagtgaataggaagataaatgttgcagcttcggtttcatttggcttatctgaattatcttaagagttttcacagtgaaagcacgttcctttttttttttctttttcttcattaa

SEQ ID NO: 390447 - DNA, 730 bp, Homo sapiens
aatacttcaattaaaagcaagagattggcagaatagattagaaaggaaaaaagcaagatcttactgcatgctgcttacaagaaaccaattttaaatataaatatgcagaaaggttgaatataatggaagaaaactgataaacccacacaaattgtgcacatcagaggactggtgtatccatttaaataaaggattaagcagactccaatatcatgagtattactagagagataaataaagatcttttacaataaaaagtaagacaattcatcaggaagatataacaattataaatacgttcctataaacagtctcaagataaaagaaaataaaatggagatcaaagtaggccaaaagtaaataagatgggggactaattttaaaaaacataaattgatgaaataataaaacagacatgttttagaagattaacagtgcaaaaactggttctttgaaaagatcagctaattaccaaactgctacttaaattgatcaagaaaaataaggaggaaacacaaataactcaatatcagggataaaatatttcaaatataggtctgatagacattaaaatgattttaatagactaaaccatattacatcaataatttttataagttcaatcaaatatgtgtatttcctgaaaaatataacttactgaaattgacataagaaataaaaatagattctgaaagtcattatatctatgaagttaatggaatttatcatg

SEQ ID NO: 390448 - DNA, 453 bp, Homo sapiens
ggcaaaataaaagtagaaaatcagaataaggcaaggcaaagattggcccacatcactcattctacacagtcctaacaaatgtgaggggctgcatatttggctctgggatccctgtaaccaaagaaaagaaaaaaatagtctaagttacttggtttctacaagataaaaataagagtttctcaggggtcacaatgttttcttctattgatgatggagggaacttggttcctcgggtcctcatgaaggggggaacactgtatgccacaggggaccatctgacttgacaatgtcctgctgctgaaggaccagtggtttccaaaggccaatgcctataaaaagcatcttcaggtccagcgcgctggctcacacctgtaatcccagcactttgggaggccaaggcgggcagatcacgaggtcaggagattgacgctatcctggctaagatggtgaaac

SEQ ID NO: 390449 - DNA, 620 bp, Homo sapiens
ctggcagggaggacagcttggcagtaggtgcaggcactggacggggacctcctggctcctctcctagctcttgcagcaccagccataaggcactcagatcatgcaacttcccggtgtctccgtctctgcatctttaaaatggggctaataagaacacttttctcatagacttataaagagaattaattaaaaaaaataatgcttggctcagaatgtacactccatgaacatcacctgttaccacttaagaagggtgcgtaccctccagccgcatccatgccagttcccgttgtctcaccctgggccagcgacacccatcttaagtcacaattgagaatacaagcaagacacgctgaaatctaccagaataaaggtccatcttcacagaacaagcctgtttacacttgaacccacagtttttcagtcatatccagacttcaaggagggaagagggctccaccgcaggcttcctgtagcaagcatgggggccatatctgagtcccctgtggcgttctgtcaccatagactgtgactttcaaacagcacagtcacttctcacagtgttaaaggtcagaagtcccagatcaaggttctggcagatctggtatctggtgagtatc

SEQ ID NO: 390450 - DNA, 258 bp, Homo sapiens
aggacacaaaccatggtactacgaaaatatattatgtcacatagaatgtaccagtatccatttaggatgtacaaagatataaaagaatgactcccaccctaacttcaaggaaaacttaaatgatgcatgaaatcataagttttccttaactagtaaaacagatgaggtctcagggcaaccaactagttggatacctaaggaaatttacatgtctccatggagcagagcatggtaggacgatatttcagggcacggatt

SEQ ID NO: 390451 - DNA, 234 bp, Homo sapiens
tcatcctatattggcattttcttgacaaagtttaccatgccatactttaaaagtttacctttaggtaatagccatttgtctttaactgtagccagtagttacctccagtcaaataatgttccttctgtattagtcaactccattttattattcagaaagtttatttttaaagtactgtgtatatatgggcaaatatataaataatgtatattgtgggctctccaggatctaaaa

SEQ ID NO: 390452 - DNA, 913 bp, Homo sapiens
ccaggcaggcaggaatggcaggtgtgcactgcctggagacagtgatagtacctttccccacctctgcccgggcctggcatgtctacaggctctgatagacgttcatattgttattgttcctcacctggtgcctggtgagacattggcagctgccagtccaaagggacagccagaagacactgccaagtgtcagttccagccatggcgctaccgaggggtgcggtgtgtcgggccctgggtgccagagcgcatccacctctgtcttagtctgttttgtgctgctatgacagaatatatgagatcggataatggataaagaacagacatacatttctcacagttgtgggggctgcaggttcaagatccaggcactggcaggatagggcctggtctttctacttccatgatggggccttgaatgctgtgacctctggaggacaggaacgccacgtccaaatacagcagaagagaagaagagagagagtccactcccgcaagccctttctatagtggcattcatccattcatgagggctctgccctaagctcctcccactagtccccacctcccaacagtggcattgggggttaagtttccaacacgtgacttttgggggaacacacatccagaccatagcagcctctgaaccaccatatccaccagatcttttgctgggtggccatgaacggggtggctccagggaattcaggagacactcagaggatcagctcgatgggggtatgggcacttccaggctgaaggctcctctgagctcagctctcagctgccaggaggtggatttcatgagcatggctcggggacccctcccatgcagggctgcagtggcagtggagaatgccagcccagccggcggatctccccgcctcaagccaggagcaccatggtgcatgtg

SEQ ID NO: 390453 - DNA, 115 bp, Homo sapiens
tgttgagagatccgtgatcacagcagcatgcgaggctgcgggaactggagccatgtgaggttctgcctctcctgctgtgccccccacgctggcaggccctcctgctccggggtga

SEQ ID NO: 390454 - DNA, 405 bp, Homo sapiens
ggacctattccagcaccaggccaaacccagtggcttcaggctccagaccagctgcccacagccctgatcatgaggctagcactcacagacccagggttcaggcttatcctagtagactccagtgatggaccagcctccatggacccaagttctaggactacacttgtggatccaggtttcagactggcccctaaagccccaggacccaggctagactttgcagacctgacccccaggccagcacctgcacactcagcctccaggccaacacaagtggacccaggctctagccagactcctaagctctaggctttcagccagcctcagtggcttcagataccaggccagcaaccatgatcctacactccagacaagctgccatagatcgtgattccacacctgccc

SEQ ID NO: 390455 - DNA, 829 bp, Homo sapiens
gcacgacatccacactgagggaaggacacagagtcagaggttgggagagagtccaggtgacattattaagcacccacgtgcagccaaggtacagttaccccagaacattctcactgggatccaggtggctgtgaaggtcacctagagaggtcagcagagctcctccagcctctggagttgacagctgtgaagtcgatataataagggccccgaatcacccaacctcaatcagctccttccagtgactgccatcgtgggcactctacactgagtcatgtagcatgccagctggggcagctacttcactacatcctagagccccaccaaaagcaggaggaagaggcctgaggcaagttccggcaaatactatctgccctacagtaccaccaccaaaagaaacatttccacaggaacctgatgccccagaatgtacttgtatttacaagatgccaactacaacataaaatatctttgtctttggcaccagatttatgataggctacaagctggacaccttctgtgcaactccctgttatactgccctatggtgaatgggtagaggtggaatctggagtaattttttacaccacaataaacagaaccttaccatttgtcagacctttgtggagctgaagaaacaaatactgtgtggcaaatataagatacagttgttcctttcttcagaaggagaagaggccaggcgcggtgtctcacgcctataatcccagcactttgggaggccgaggtgggcagatcatgaggtcaggagatcgacactagccgagaccaccctaggtaacatggtgaaaccccgtctctactaaaaata

SEQ ID NO: 390456 - DNA, 323 bp, Homo sapiens
ttgaatctgtgtgctggtttctttgatcagttctgaaaaattcttaggcattacctcttcagtattgcttttctgtgttctctgttccagagagtgtttttatttcgtctgcttgtgtatattagtttgggttgttcagagaaacagaaccaaaatcatatgtagatatagatatagatagatttctttatacatgtgattgtagaggcttggcaagtttacaatctgcaaggtaggcttacagtttggagacctaggaaagagttgcagttcatttcaaaggcagtcttttggcagaatttcttcttgctttgggaggttgg

SEQ ID NO: 390457 - DNA, 316 bp, Homo sapiens
cagcagtcatggtgcctcagagcactgtcttggaaggaagaaggtgcataaaatggaaatcacatttatcaagttctatgctgctgctagtgctgaacaggataccttaaataaatatgccttttaacactgacaatccccagtgcttgttatatctactttatagaagaaaaaaactgaggttcgaggtgggttccttcattcatatatttaagtgcctcctagggacctcagtactggggacactaaaatgtacaataaagaccctgtccctgcctcacaaagcttgcatccttgtaggggagtgtcaattcaa

SEQ ID NO: 390458 - DNA, 241 bp, Homo sapiens
atggatgtggccccaccatctccctttctgagtggcacccacacagcagtgaggctgatccatgggccaccacccagcagcctggctcgctgtcggggccatccctgctgcctcccctatgacgcttcttctgtggtttctgatgcgcttttctccattggccgttgcgcttgtctgctgggagcctttgccttcttttgtgttgaaatcctattttctctgagctttgccctccacttgc

SEQ ID NO: 390459 - DNA, 247 bp, Homo sapiens
tcagagagttcacactggagagaagccatataagtgcagggagtgtgggaaagccttcagatggagttccaatctctaccgacatcagaggattcactctcttcaaaaacagtatgattgccatgaaagtgaaaagactccaaatgtggagccaaaaatcctcactggtgagaaacgtttttggtgtcaagaatgtgggaaaacctttacacgtaaaagaacccttttagatcataagggaatacac

SEQ ID NO: 390460 - DNA, 468 bp, Homo sapiens
agctttatgcatagcagccaaaaaatgaaacagcccaagagttcaacaacaggttaactgacaaacaaattgtggtacctatatttacataatagaaccctgctttggtataaaataaaccatggatacatgcaaaatgtagataaatctcaaatacattattctgagtgaaagacgtcagaccccaaaattacaaatggtatgattcaacatatatgaaattctaaaaacacaaaactgtagttacagaaagcaaaacaatggtggcttggggtatcagatgaggaggatggacttgaaaagagcacaggatggacttttggagtgataaaaatctgtatcatggttatagtgatgattagatgagtgaatgaatttgtcaaaattcatttgtctgtacacttaaaatgggtatggttgtatacaggttaaacatcaataaaaaaaaattgctgtactaatattgtt

SEQ ID NO: 390461 - DNA, 395 bp, Homo sapiens
gagggaaggtgaaggtgagtaggagagtcctggggccagggagccaagaggaagggctgccctttggggtggacaggcagagggactggaagcctaaatctggaaggctagggggtgatccgcacaaggatggatgagtgggcgcacagctccattcacctgcggggagacccagcgccgcggccgtgtcctcagccccgtcctcctcttcacagggtctcccgtctcccacccgccggagatggaggcgaacccagcgggcagcggcgccgggggtggcgggagcagcggcatcgggggcgaggacggggtgcacttccagagctaccccttcgacttcctggaattcctcaaccaccagcgcttcgagcccatggaactgtatggggaacacg

SEQ ID NO: 390462 - DNA, 435 bp, Homo sapiens
gacccttccaggaacaaccagtctggtggtgatggggtcatcttttggcctcaaatgccaaacaagcttgagcctctctttccccgtcttctgacacttagactcacaaaggagcctgcaagcctaagggggatgaaactgcatgcctttggagatgaaactggacttgtgtgtgggcgctgagcattaaaggttgggaggtgagggtgtgtgcagttggatattataataacctcagtaatgattcacacatgtaaggcaaaaataagaagctcaattcttcctgttaaaaataaaggatgccgggcatggtgtcacgcctgtaatcccagcactttgggaagccgagggggatggatcacaaagtcaaggagttcgagaccggcctggccaggatggtgaagccctgtctctactaaagatacaaaaaaaaaa

SEQ ID NO: 390463 - DNA, 289 bp, Homo sapiens
gaaaccataaatggcagtgtatgaaaaataatttaaaaaacaatgaacctaacgtttattgagcacttatgatttcatgcacccttctaaggactttatatggattaatttatataaatctcacaacaatcccataacagatactctatcattgttctcattttattgatgaggagaaaggcacaaggagcttagataatttgtccagcatcagacaatatgtgtcagatttaggattcccacacaatttgactgaagacaatgggaaaagggttgtatggtgaaggaa

SEQ ID NO: 390464 - DNA, 545 bp, Homo sapiens
tattgtttagcactttaaatcctcacctgctgcttctgttgaactgtaccacttatctacttgtttaacttttcagatgtgtatattgtctcctcaaccagatgacagttccccgatggcagagaccatatttatgccttacacttagtctccctcaacaaacacactactctgcatagatcagatattctacacatgtttaaagtacggatgagagaaccctccaggcaaacagaaaccttgagtttttccactaaacataactaacagctaaaacgagatagttattttcttaaatgtttaacatttttataatgggcaggcccagtgtctcgcagacctgagagtgcatcagcattacctggaggttttctaaaacagattgctgtacccacccccagaatttctaatttaataggtcctgggtggggccctaaactttgcattgataagttccaggtgatgttgatgctgctggtctggggactgactgcccctttcagagttatctggcatggacttaggtgaaaatagactattgggag

SEQ ID NO: 390465 - DNA, 224 bp, Homo sapiens
cctagaggatccctatagcacttatatatctcagagatatacaggtgatggatggatagatagtctggtggatggatgggtgatgaatggatgagtcgatagtgttcatctaacagaccagtagataagtgagtggatggatggatgggtgggtgtatgggtcaaagggtagatgggtggatgggtagatgttagtgcagatggtttaatgaatagatgataag

SEQ ID NO: 390466 - DNA, 723 bp, Homo sapiens
gtaatcagcaaacaccctggccagaagcttggtcacaaaagaggggaggggaggcaggaaactgggatgggttgtagaattgaggctgcactatcttctgaggttatatatttcaaattgatcatgatgatgatggtagtaacgataacaatgaccaacatcaaatgtgtaccagtaccaggcattgttctaagtactttgcatgcattcatttaatcctcttagtaactcaatgaactagcaactcttattgtcctcgattccacagacgaatcccagcacagctgtcacttgctgaacgtcacatagctagcgagtgggggagccaggattagaaccagggaaggaaggctaaagaggctgatgagggctttgagattgtgtgctgagagccaaagcggggagagaggagggagagtggattatttcatttaattctcacaaagcactctggaggtagctattgcaaacttgactccacctttagtttaaaaagttaacttctccaaagttcataaaatatagtaacaattatgtctaaagtatcttgagcacttactatgtgcctggcaccttacgtctattttcacatttaaccctgcaagcttgtaagaataggtgctattatcatcattttagagaggaggaaatggaggcacagggagactaagaaacatgcctgagattccaaagcatggaaaagacagagctgggattatttcc

SEQ ID NO: 390467 - DNA, 370 bp, Homo sapiens
cccatgtagtcctgtgtattccctccagtgtaccatcctccgccataatgatgtgctgttgggcactcatttgaaaggagaggagactttataccattatttcagacaacaacagagctatgaacaagtagaagttatagggaggctaattttgaacccatataaagaagaattgatctgtccaacaatgaaatgtgttgtcttatgaaggagtgaggcctcttgtcattgaactgttcaaactagggctgactgaccatctggaaggatcttgcagaaggcatttctgcattgggggaggtggggagtgtgtttgtggtgctgagagatgttagatggcacctaagagccctttcaactatgaaattgt

SEQ ID NO: 390468 - DNA, 289 bp, Homo sapiens
atagttggcttattcagaaatagaatgggatgcctaggaaagagtagtacattctctaccaatagctacgttaatgtggcaattgtaaaagccaaatgtcaagcgttggttaagggttaagtttctgttttaggtggctaaccaggaagaaaaaagcctttaagattcctctcttttctaagattcaacgaattatacatatgctcacatatttgtcataaaccatgccaacctcctaagcagatatgtatacaacaaattcagctgaaaaagaaaatgtacatactgt

SEQ ID NO: 390469 - DNA, 298 bp, Homo sapiens
cactttcctcccattgatgcctcctttatttttaagccctttcctcaggtgaattcctttctctcctctttcttttttaaaaaaaattttttaattttttgtaaaaataaagatggggtctcactatgttacccaagctgaccttgaacacctgggctcaagagatcctcccacctcaacctcccaaagtactgagactatagctgtgagccaccgcacccaggcccctcctctttctgtcgctccattcttttgctgggactttctcttttcttccaacctgattactgtcctttga

SEQ ID NO: 390470 - DNA, 114 bp, Homo sapiens
ctacatttcccagcaacccttgcagccaggtgtgatcaggtgaccgtgttctggccaatgaggtgagtggaatgctggttgtgacaagggacacatctttttgttttgttttta

SEQ ID NO: 390471 - DNA, 388 bp, Homo sapiens
agggtctacactcaaatcaaatgtcactcactttataacaccttgtacatatctcccaagaaattgttccttctgaatttcctcataattttgcttattcacttgtagcacttccactgttttacagttagtcaatctaccccagctacattgagttcctcaaaagataagggcttactcactgccagagatactcaattatgtttttgtaaatgttacttcctttgtttttctcttccagagcctcagcaagagattaagactatgagatctaatttttactattaacaataaaagtcacttaaaaaaataacagttcctcaagcacatataaagcatcacttgtaacagcaaaaactgtaagcaatttaaaagcccatcatgtaca

SEQ ID NO: 390472 - DNA, 365 bp, Homo sapiens
tatcttcctcggcaagaattttctggagcagagaggaagtcactgacacaggtggtctcgatgctcactccaagagttgagttgtgtggctccaggtagactcatttcccagggtcacctgctgggccataatcaacaaggtacaagcttaagagagccatgccgggatttcaagttgcaaggaagagagattcaatggtgctttcttgagtcacgggtgttggttgtaagaaactggtggggtaaggaagctagaactctcccaggaaccaggaacggctctcactggcaggcctcacggaggagacccaagctgggggactggaaggtggttcagattgttcacaagctgcagtggctccagc

SEQ ID NO: 390473 - DNA, 750 bp, Homo sapiens
gatagaggaattagctgagaaaactaacatagtttcctgaaatctagctctgttctctgaggcattttatctctagtaccatcctcaggtccacatggcttgcctcagttctcttcagagaatcgtttttttaaccaccctttgtagaggcctatctttttgaatttccttgaggtttcatgcttgtattttgtgtgtaggaatcctcagagctgccttgatcctgcccagatccacaggctagtgctggttgcttggaacaaggaacgacccaggtatccagtgggtacaacttctagctgggtggacagacagcatggaaccatagctctacacacactagcatggctccagtgtcttccagttggggatgctagccttctgaaggcaggaggactgcagcctcccaggctggcagtatccctgttccgttgttccatgccctcagcataggataacatgggttgatttgggtctggattccagtgctgactgtcactgactggctctgtaatgagggtaaagggtaaaagttctctgagcctaggtttcctcatctgaaaaaatgtggattaaaaataatactccctcataagttgttatgaagattaaataagatgatgtatgaagaatactggacacttggtaggtacttgaataaagaagtgccaaccactcttcacgatctcattttttattcccatattgtatccccacatgtgttgttgctgagcctcataccagcctcaa

SEQ ID NO: 390474 - DNA, 118 bp, Homo sapiens
agctattctgaactacaccatacactgctgttaaccctcgtcatcttactgtgcaccagaatgtactccttctgtctaactgtctgtccccttggccctgttgaccgatctctctcca

SEQ ID NO: 390475 - DNA, 553 bp, Homo sapiens
acatacttaactatgacatgcctgcacattactattttctgtgtcttggcagtgccagtatataatctgtatatattgtatgtagaaagagatatacatatgtataatctaaaatacctaagatatgttagaattttaggttctgctcatatttaaaatatccttgacattaaaaaaagaattctaaagttgttgttttggccaaaatatctgcaaaacgaaaataagttaaatgtattcctactcagtatttggcaacaatcatgactgagtttcctcaaaacaaaaacaccagaaaacaaaactgacaaaaatgaattagtgtttacaaacacacaaatacaatagcaaaattcttggctacagtgaaaatggtttaaatatcaaatatcaatagcatagtattttaaaatcttttcacaaatatcccaaaaagactattgttaaataaaactttaattaaagtatcacacgtggccaggcacggtgggtcacaactgtaatcccagcactttgggaggccagagtacacctgccgtgggtccgctatctt

SEQ ID NO: 390476 - DNA, 393 bp, Homo sapiens
ggtagatatggggtaaatagaagttgttttagaaaatgtttcaggagtgatggttccatccaggttgggaagagtatgggagagcatccagaaaggactacagaagctggctgaggacagatttgtcaaggaacatttgcaaagaggctgcagctggatactaccaacaggcacttctcccatgaaggacaaagggaagcggaccatgctgagggagttcaagggaaaaccagagagttgaagttgagctaaaactaatatgaagtttcgctaaaactaagggatatctgtggcattaatgagagacactttccccttaaaagtaagctccatggcaacacacaccttgcctactctactattgaccctttgccagtactaccttagatgcac

SEQ ID NO: 390477 - DNA, 500 bp, Homo sapiens
ctgagatccctttcgacggtgttctggtgtgtatagcacacttacagcgcttctcaattcagactagctacatttcaaggactcaagggctggtggctactgtaccggacggtacagctctaagaggatctcaaacctacacacccatctgcaacacagggagccacataatccaactagcaggctcaatacatcctgaggtaaatgaagcacatttcatgtacacacactcaccccagaggcctggcaataaagttcttttacctatccattttcagatatctgaccccccaaatttttgtggtagaaatatcagagggtgggtacatgaggagctacatgtttttcctgggagataacatagggaacaggcatgataggaaagaagatacagtagtatattctctttcatctgtaacttttatcccttttagctgggctcaactctgacttaattttgagatagagtctcactctattgcccaggctggagtgcagtg

SEQ ID NO: 390478 - DNA, 263 bp, Homo sapiens
atactacgttaaaatttccctagtcttgcaaaagatttacacattcaaatataagaggcccagcaaataccagaaaagtgcattgcaagacatagttcaccaagaaatatagtcatcaaactgtataaagtcaacatgtaggaaaaaatctgatgtctagttgcctataagagaaaccttatcagagtagcagtggacttctcaatgtgagacttaacaagccagaatggattgagagccttttttctgagttcttaaagaga

SEQ ID NO: 390479 - DNA, 214 bp, Homo sapiens
agcttcctctctccttctctcctactttagttttatcttctcttacctacatcccatactctctctccacttcactttcaccctctgcacagtggggttactttgggccctggcctacattttttgactgtcttctcttcttccctctcctcacttactagtccttccctttaaaagggagacaccaccttaacagaggggacccagccccatg

SEQ ID NO: 390480 - DNA, 263 bp, Homo sapiens
gtgtgaatctgggcccttccccatctcttgccccgcccagggctgggcctcgaaggtagcctgggtctcttctctaggttgctagggtcgcagtgtctaggtctgggctgggaggaagaaggactcatccagcttggagcctgagctgtggttccagcccgtcctttgagccagggtgcggggcacttgcccgctcagcgctcactcaggggttactgtcctgtgtatggccaccaggcagccgccgtaccactgtgcataag

SEQ ID NO: 390481 - DNA, 337 bp, Homo sapiens
ttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggttta

SEQ ID NO: 390482 - DNA, 692 bp, Homo sapiens
agactcctgcctcagccttcaaagtagctaggattaacaggcgcccaccaccacacccagctaaatttttgtatatttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacagtggcatgatcttggctcactgcaacctctacctcctgagttcaggtgattctcctgcctcagcctcttgagtaactgggattacaggcacttgccaccatgcccagctaatttttgtatttacagttgagacggagtttcatcatgttggccaggctggtctcgaactccggacctcaagtgatccacccaccttggcttcccaaaagtgctgggattacaggcatgagtcaccacacctggcctacctttttcctttttattgctgaacagtattctgtagtatggatatatcaaaacttagactgatctgttatggaagtttaggttgtttctaatttttagctattat

SEQ ID NO: 390483 - DNA, 401 bp, Homo sapiens
agactcctgcctcagccttcaaagtagctaggattaacaggcgcccaccaccacacccagctaaatttttgtatatttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacatgagccaagatcacatcactgcactccaacctgggtgacagagtgtctgaaaaaaaaaaaa

SEQ ID NO: 390484 - DNA, 571 bp, Homo sapiens
ccaacacttagtgctgtcagacttctttcattctagtgggtgtgtagtactatatcgttttaattttcatttctccgatgactagtaatggatcttttcatgtgtcacttacatattttcttttgtgatgtgtctattgaaatcttttacccattttcaaattgggttattttgtttataattgagctataagagtgctttatatgttctggttacaacattgttaaatacgttttgcaaacttttgtcccagtctgtgctttgtttttttgtcttaactgtggctttagaaaagcagaagttttacgcctgtaatcccaccactttgggaggtcaaggcgggcggctcacaaggtcaggagattgaggccatcctggctaacacagtggctaacatctctactaaaaatacaaaaacttagccgggcatggtggcacacgtcagtaatcccagctactcgggaggctgaggcaggagaattgcttgaacccaggaggcatgggttgcagtgagccaagatcacatcactgcactccaacctgggtgacagagtgtctgaaaaaaaaaaaa

SEQ ID NO: 390485 - DNA, 687 bp, Homo sapiens
atccatattagtatttacattattatgattatgtaaatgcttttcacagcaggagccacatggtaaactgtgatcacttttcctgttcctatttttgtttttctctactttttaagaatattttcagagttagctgtcttgtttcttttgtttactttttcaccaatcgtctaattctgtcaagaccttcagacactttaggtgttctatccattttatcttcttaagcgtccggtctgaactggttgtttttgacatccggttttatggcttccttcctaggttctcccttcacctctcaccatgttggatttcctgtctcctgtattccatttcttgctctttcttggtccattccctcatttttgtggtgttaactccctgatagtttcctgagaaagcttgcatgagtggtaaatgttttagactttgcatatctgaaaatgtctttatgtttccctcatacttgattagtaatttgagtaaagaattctggttggaaataatttttctatagaattgtactttgcctccattttacttcactttcccatttccagtgttgctgttggtaaaactgattccattcagttcctatccttgcagacctgctttaccctgaaaactttcaggttcttccctttatcctgggattctgaaatttcctaataatctgccttggcatgg

SEQ ID NO: 390486 - DNA, 708 bp, Homo sapiens
gtggcgttctagaggatccctcacgccatgtcacaatagccagtcggcgctgaggcaggcaatgatatgggaaatgatgatgccattggagggaatgtgagcaaatatatagtgcttccaactggctatggtggacagcccaagaaaggacatcttatctttgatgcttgctttgaaagtggtaacctgggccgggtggaccaggtctctgagtttgagtatgatctgttcattaggccggacacctgtaatccacgcttccgagtctggttcaactttactgttgaaaatgtgaaagaatcacaggaaatcttattgataactgaagtgaaaactaagagcttgggcatatcctggatgtaaagaagtaggcccctgtgatagcaatggaagaaagtctgcaggtaaatggtacattgaggcttatgacccagcatctaataaaagcttatttaatgtttttgattaaatgaatgagtaagttgggcctgctcccaagcactaagccctgaggtcagggtgttataagccttattctaaataccaatttctgatacggatagggcttttcatgtacatgcttgatgttcatgggcttgatgactggatgggactaagatataaggtgcaggtctccggtacctgccacttggtaaggtcagggaccttgtgtacatggcgtgagggatcctctagacgacctcgcat

SEQ ID NO: 390487 - DNA, 465 bp, Homo sapiens
aaatgtgggcagactctgaaagcctgaggtttcaaaccctgaaccaatgtcagaaaatacgtcatttgtatggatggagaagaatgggcaaggaagtgaaaagagactactatttccagaatgtcacactgcttttgcacactctcaaataggcatctgcttgtgtgggagctgtgattccctctcccctccccactgtcctctagtattgtttaaaaatgacggaagaaacaatagctagctccacagaagtcatcctcacaagccagatgtcaagtgagggctggcaacgttggggcaaaattaaaagtgatggagggggaaacagtggtgtgccccttgggtggatagaaggtttcattaatgtctgtgatggaatcatgaaccacaacagtgaggcatttccgcctctggcctttttttggtttttgttttttttagaatcaggatctcactctgtcgccc

SEQ ID NO: 390488 - DNA, 519 bp, Homo sapiens
taagaaatctaactttgtggaatttcaggtgtgtccctggttgtcttagcctgatggggacactcctgtgacctttctgttttccagcccagtgtttctcaaatcagcagcgtattagaatttgtaggagattcctggagcctttctgagaaattctgattgaattagtcagaggcgtgttctgggaatcagaattacaaagttccccagttgattctaatttgtaggcaaggtgatatatgccaaactgacccaggatacaggataccctggagtggatattcaaattcagtttcacaggaccaaaacaaccttctaactcaaaatctttggctatgtacctgagtattctgtaaggttaatgaagacctcaagtcacactctcaccatggaagattaaagacattgcctatcatattccacttcttgtccaaaacactttctcaatttttatttttacttttcatgattactactgaaccaagggtaacataggagggaaaaaaaggaaacagtgca

SEQ ID NO: 390489 - DNA, 678 bp, Homo sapiens
ctccgtctccaaaaaaaaagctttctgctgcttttaagggacaaatctaatatacaagtatataaaaaggtagaaagtaaaaggatagaaaaaatataccacgcaaaactacctttaaaaaaagttgttgtcactatatgaatatcaaagtagactttaaaagcagtaagaaaggatggttgataatgacaaaaggtttattttacacacagcaattcattaagatcaagtggagtttattgtaggaatagagtactggtttcacatctgaaaatcagtcagtgtaatttaccacattaacagaattaaaaagaagtttattatataaagataagcattttgcaaatgcaaagtaccacttatgagttttatttatgtaaatttatttatgtaaattctgtattttttgtcacatttgtgatctttagaaaaaagctctcagcaaaagagagtaagaatgagctcccatgagtagcgccctgaaggcctcagagaagtctacagtggaacagtgggtagctccttaatcttctgtcttaaaaatcctacacaggaaattacttatcttagaaataaataaaatattaaaagctttttctctgaaatcctgacaaggatgcccattatcaccatttctattcagtgttgtactagaggtcttaggcagtgcaaagagac

SEQ ID NO: 390490 - DNA, 220 bp, Homo sapiens
tgatatctctgcccctcatagccaaacttgtagccacagtggtatattccttctgatctgtctgtggcttgttgcttggtatctcccctatgcagcctggttaaagttcagttctggggcagctgggctctgctggggctttcttagggacttcagtggaggctgctgaagggactggttctgacctcctagtgctggccctggctatccctcagcctct

SEQ ID NO: 390491 - DNA, 891 bp, Homo sapiens
agtcactcagtcaccctgaacttcagctggagaaggggaacaggaataatgcctatcttccaggagtgttctgcacaaaactgaaggcacagatgaaaaagcactctgcaaattaaaagagaaggatggatagagaaaagcatcattacaaaagtgaaatgtgtgaattttattctggctttgaacattgagtagacgaagaagacaattccagacggaggaaactccacaagaaatatcatggaaatttgaaagaacacagtgggcttgggaagaggtgcttccaagaccaagataaccaggcaatcatagtagatgcatcaatgcacccttgcccaagggcctagacaagaggaggaaggaaaggaggagcacgtgcacaaagctaaggaggtgattaacaacatgatacagtaaggaccagccaatattaactgaatttctaagctgtgccaggacctccatcatctcatggaatcccaatggcattcaatgaagcagccttgggattcttctatttcataatggaatgagagaaatgaggctcacaaaggttggataacttgcctgaggtcacacagttgacatatggcagagccgggatgtgaacacatctccctgcttgaaaatctggcttctcacccgtaaaggtattgtttagcttcgcatgaattttatcaccttgcctagaaccagccaccatctgccagggctcctgactttttctgaaatgaatagacactaaagcctgctggggaatttcatggaaatcaagatgactcaacccagagtccatttcaaggctaggatgctagaggacgccaacaaaggagtagggaagtgaaacggatcagctcacatccaagcccttgcatgatcaatcctgcagta

SEQ ID NO: 390492 - DNA, 435 bp, Homo sapiens
atgctgttctagagggtcaccgtccagtaaggtgtgcccattgtgcatcattatagttttatctaattcattagatatttgcaagcctctactatgccaatgtaccatgccaggtacttgaggcatacaaagataaatgggacaagttctcggctgggcgcggtggctaacacctgtaatcccagcactttgggaggccaaggcaggcggatcacttgaggtcaggagtttgagaccagcctggccaacataacatggtgaaaccccgtctctactaaaaatacaaaaattagccaggtgtggtgggtgcctgtaatcccagctactcaggaggcagaggcaggagaatcacttgaacctgggaggcagaggttgcagtgagccgagatcgtgccactgcactccagcctgggcgacagtgcgagactccgtctc

SEQ ID NO: 390493 - DNA, 285 bp, Homo sapiens
aagaggcgcccgacgggtagtggagttttcttttgtttgggaaagagatggagtctggctacgacccgggacattcccctgcccgggctccccgaactctcactgctgattacatacgcccctggctgcctttcctttcctccctaccccactattcaaaactatctgcaaagtttctgtcccagtcccacctcccgccgtacatgagggaaggtttctggagaagcaacagcagacaaggcacaacttttcgtgctaggccctaaaacgacccccagcgccaat

SEQ ID NO: 390494 - DNA, 110 bp, Homo sapiens
ctatgcatgtctctggaaccaggttcagggcacctagagttttgtgatggagtgccaggtgtaggagggacatggtagatccagaggtgctgcatcctgagagcctcctg

SEQ ID NO: 390495 - DNA, 408 bp, Homo sapiens
caccccctcgtctcttacccgtgaatgttaagtttcttctggggtgcaccctcgtttcgtttcttgggttgtggtgcgcccaaagggttagtgccaatgcgaattctgacatttttcatgactttgaggatgcgactggggcgcggggagggaggtgtccgactcgtgtctaagtagttaaagtgattcttcacagacttctacacttattttcaccacattttacataagagaatattgagcaaaatttctcctctcgttttgtctgtccttaaaagatagtctctttatggtgttggaatttggcgcttttaagctttttttaatggattgggtacgtttcttttttattgtaaatactgagtcaattcaagttgggttatttttaagttttcgttttctcttttt

SEQ ID NO: 390496 - DNA, 364 bp, Homo sapiens
ctacccactgtgtgctaggtaacagcatgactgagacagtgtctttgttctcaatggcccaagttctagggaggggcccagacatgggaacaggcaatgaccttgtggtgttgcatgagttatgaagttacgacacggaagcactgggtgccgtggaagctcagggtgggggtaactaagccagttgggaggcaccccagagctttcccagaagaagcaacattcccaccaaacatcacagggcttaggtggaactagggcctgctgaacagggggaaagaaggtggggagggggctttcctaaccaaaggtaatagtagggtgagggtggagaggtttaaaaaaaagaccagggagccttttg

SEQ ID NO: 390497 - DNA, 156 bp, Homo sapiens
caaatcaagagagtgctcagcatcctcgggagacccctctgaagctttcaaactgagaagacgaagttcagcaattcctaagcgagtcgagtcggagcagccgcgcctgcaatttaaaagctgcaggatcctgggtccctctagcagcctgggccc

SEQ ID NO: 390498 - DNA, 315 bp, Homo sapiens
gtctcattcttttttagaataattgtcagttaatatcctttgcccatttttctatctggtctttagaatattattcataggaattatttttatatttagtctaagacacactttttttcacattttaacatctttgaaatctagatgcatcttattaagatagcatgatatgctttaattatttaaaaaaaatgtttttggccaagtgtagtggctcacgcctataatcctagcactttgggaaatcaaggtgggagaattgctttaggccaggagtttgagactacctggacaacatagtgagactccatctct

SEQ ID NO: 390499 - DNA, 365 bp, Homo sapiens
ggcctgcctccctggaacttcttagtgtcaaaattttatactccatgcttgtagtcataaggcctacattttatggtcatgtaggtttttaagggtgtataggtcttttgccattttaaatagtccaatgaatagctagctctatagataagtcatttagtatttttttttctagtgtatttggggctagatttctagacgcaggattgctgtgttaattcaatgcatgtgtacttttcccttcgtgtcttgtgagacttggatttttgccagttgatacctgagagtagtttcttcatatagttttattttacatttctcatagttggaatggggcctatttccatatgcctaaaggccatcac

SEQ ID NO: 390500 - DNA, 900 bp, Homo sapiens
taagaaaatcactccaatttgcattttgcctaacatcatttccatagtctaaaataaatataaaataaacagcaagtaataagtcattagcaaaaaaataaagtaagaaatgcacattaaaatgatgtataacataaccacatttatttaagactatattccaatatcaaatggcaaatttcagcaatgcaaaaactgcaattacttttgcaccaacctcaaaacttgggacagttgtcaggtcaagattttgtttcaagcaatgctggaagctgagggatcataagcatttgtgtgaagactggtaggctggtttatagccagaggaccttctctcaacaagattctccacttgtgaactccagcccttcttcctatctatgcttcttgccacttctcttcctttaccagcccatgatttcagacataaggataccctgttggagcccacattacttgcccttttttgggtcctacatgttactcacctgtttccctccacttccatctctacctattatattcccttcatttttcagcatccaggtaaaatgatatttcctctaagaagcactttgtagtccaccaattaaggtagatttctcccactcctgtgacccatgaaaattttattgtactagctataataatctgacttatattgaacttagctatttatgaggttttctcaagctcactgtaatctccacaaaggtagccaccatgatgtagtcatgtttgaatcctcccttcctaaatactccctatacgccacctagcccaagtattaattactgatggtttgtgacatagacaggctccgcaaaagtttgttgaatgcaattaagactaaggacctttggcttctttgatgcctatgttctttcaggtaaggtaaaa

SEQ ID NO: 390501 - DNA, 804 bp, Homo sapiens
cattaccaaatccattatagccatccccactgccaccatatccaccaccaccactgaagtttcctccactaccagtgttgtcattcctgccaaaaccacctccacgaccaccgccaaagtttctagaaccacttcagcctctttggctggataaagccctagccatctcttgctttgacagggctttcctaacttcacagttgtggccattcacagtatggtatttctgaatgacagtcttatccacggagtcatggtcgtcaaaggttacaaaggcaaagccccttttcttggcactgcctcagtgagtcatgatttgagtcacttcaatttttccatactgttcaaaataatctcttaggtgttgttcttcattgtttaatgccaccaacaaatatctttttcatagttaagtgggcacctggtctttgagaatcttctcttgagacagctctctttggttccacaactcttccatccaccttatgtggccttgcattcatggctgcatccacctcctccacagtggcatgtgtgatgaacccaaagcccctggagtgctctgtgtttggatctctcattaccacacagtccgtgagcgttccccattgctcaaaatggctcctcaggctctcatcggttgttttaaagctcaaccctccaatgaagagcttcctcagctgttcgggctctttaggagactctgacttagacatgacggaagggagaagagagactttaacgatgcttcttcagtggcgtccgcgggcagaaaagaacaagctgatgaacgtgtctcactgt

SEQ ID NO: 390502 - DNA, 775 bp, Homo sapiens
atgtgggagaaaggaaatacccattccaacccactgtagtatcctgtcccaccaaaggagaggaaaaaaactgaaaagcacttgtgaagttaacagttcagaagcacaggctcactaaaagactaagaacctaatcataggactgcaaaacactttccctctcccacatcttaataccaaattactaaagacctatttaccataattccttttttacccaggtacatcatgtccagctatcaagaaaaaaaattacaaggcatcctaaaaggcaaaagcagtttgaagagaccaagtaaaactaagagagtaagcaccaaaaccagactcagatatggtggggatactggacttaccatatgaagagattaaagcaactatgactaatacactaagggctctaatggataaagtagatagcatgcaagaatagatgggcaatataagcagagagatggaaattcgaagagagaatcaaaaagaaatgctagcgataaaacaaatttaaaaacccactgtaacagaactgaagaatagtagactggacacagctgaggaaagaatccctgagcttgaagacattatcaacagacacttcccaaaccgaaagacaaagagaaaaaagatgggaacctcctccaccaaaaacaaacaaacaaacaaacacagaataaaatatccaagaactgtgaaacaattacaaaaggtataagtgtactagaacaccagaaggagaagagaaagctaaagaaatctttgaaacaatcactgagaa

SEQ ID NO: 390503 - DNA, 287 bp, Homo sapiens
aagtgaacaatgtgcctctagcatgtattcaaatgaagaatttttgcctgaatattggtactaaaacatattaaaacccaaagtcaaaacatcatattagttatagcaggaaatttttctgatatatgcagcagaaggaaattgaaagcattatttccaaattgatcacaacaaacaaattcaggcaaatgaaagtccaacacatcatgatgggcgatgtctactacacccactccacaagccacatggccttctgggaacacagcctcgatgccacttgattctgt

SEQ ID NO: 390504 - DNA, 353 bp, Homo sapiens
cctaagaggggtttttaaaaaattaatcaatttcaaagattgacagataaaattatgtatatttaccatgtacaagtatgttgttttgaaatatggacacattgtggaatggctaaatcaagctcatcaacacacgcagaacatgcttaccatgtttttgtggtgagaacacttaaaagctacttttagtgcactgctgatgggcatgtaaattagtacaaccattatggaaaatggcatgaaggttcctaaaaagttataactaaaattaccacatggtctagcaatcccactacagggtagatactccaaggaaatgaaatcagcatgtcgagatatctgtactcccacgt

SEQ ID NO: 390505 - DNA, 414 bp, Homo sapiens
tgactctatgaggatcccctgccatttactccatggctaagaatggaaagaaaatgaatagttaaaaatatgttttggcattgtacagacttcaatcaatcactctgttttctggacccaacagaatcatcaatgactacccttactcaattctctcattactcaagaattttggagatgaaacccaactgtgaaatgaaaattcttaaatggtaatactgttcatctgagtatgtttacagtacttctgaatccacataccttatcacccctcaccttccaacctcagaatatctggccaaaaggaggtagcaggcaatgctgaaggctgctccttggacaggggcagtgtggtcagccttgtcatcgggaggcatggtgtggccatggagtaaggacatcttagaaaaagac

SEQ ID NO: 390506 - DNA, 951 bp, Homo sapiens
taggcaatagagtgagactctatctcaaacaaacaaacaaaaatttaatctgctataatagatactaatttattttaagaaatacttagtgaatgttgttctacatacttgccaattgggaggaaaaaagaaatattcactaaatgaatgaatgttatacaccaagtatctccttcattttatgtcatggagttctagcttctgatatcacagaaatatgtgatttctaaaatgtttcagactattgtgataagtattggaaaatgcatcaagtgactctaaatatttaaacatacatcacctatatttcatataatcctgattcaataatatttctatagattttttatgcaatttggtaattttgtttgtttgaaacacagtgctatttcatatatttctattgataatccaatttgacctaattaggcatatttctcacacatggtattattgaacatattgcacatttattaaatgatatgtattttacttaagagtactttatataatctataatttttgtaatttgtacttataataaatcaaatattaagtgggattttagccaaaccatctagacatttttgtcataatgtttttattaaaacagcaaaataggagtttcaaaatattttaaaatttgaatacttctaaaatgtaaaatgtttgcaactggtgtaatgcagttgattgtctatccctctaaactgtctaaataacttaggttcaagaacagtttattgaagaacataggaactgcgcaattctgtgttttatcatttcagttttaatcaccccggcttgattatggcaacaacattttagacaagcaattattactatttttgaggcccatatactgggccattatggttttgcttctaacgtacatataaatgcacatgcaatatatataaattatgtttgctgttttaaaattagaaatgc

SEQ ID NO: 390507 - DNA, 226 bp, Homo sapiens
ctgaatagaccaattgcactcagttttgtggcagtggatataaaagaaatatgaagaacctctcgtcagtggggcacaatgactcacacctgtaatagcaatgttttgggagaccaaagtggaaggatcgcttgagacccggctgggcaacatagtgacactccatctgtacaaaaactttaaaaattagcctggcatggtggcacacgcctgtagttccagcgac

SEQ ID NO: 390508 - DNA, 771 bp, Homo sapiens
tgtggtggtgcacacctgtagttccagctagtggggaagctgaggcaggataattgcttgaacccaggacacagaggttgcagtgagctcacgccactgcactccagcctgggtgacagagtgagactctgtttctcaaaaacaaacaaacaaacttctaaagtcacattgttaactagtggcagggccagtggttgaagaaaggcagcaaggctccagagtcccatcacatgctgtctttcggtatttctccctccaaaatgaaggaggacccccgcccccaatcccacttcatactggaaacatgcattgctccacccatctccctgccaacaaatcccaagtctcttggcttgacccaagaccagaacaagtcaccaacatttgttgacctctaacaagcattgtacttaggtgccttatgtggcttgtttcattcaaacttcacaacaaatgtgttattattattcccattttactgacaggaggactataaccaaagcatgtctatcctcggtcccaaaccaaacagtaaccccatctcattcaaaagccacagtcctgactgggcacggtggctcacgcctgtaatcccagcatttttggaggccaaggcaggcggatcacctgaggtcgggagtttgagaccagcctgaccaacatggagaaaccccatctctactaaaaatacaaaattagctgggcgtggtggcacatgcctgtaatcccagctactcgggaggctgaggcaggagaatcacttgaacccgg

SEQ ID NO: 390509 - DNA, 419 bp, Homo sapiens
tttatatttagttgtttgcttaatatttctgcccttcaccagagtgttagcttcttgaaggcaggaacttcgtgtgtctgggtcactgccaaacccctcaggcccagaacaggccctggcacataataagtgcttaggtaggccgggcgcagtggctcacacctgtaatcccagcactttgggaggcaggaggatcacctgagatcaggagttcgagaccagcctgaccaacatggtgaaaccccttctctactaaatgaaaaaaattagccgggcgtggtggcggccacctgtaatctcagctactcaggaggctgaggcaggagaaacacttgaaactgggaggccgaggttgcagtgagccgagattgcaccattgcactccacccttgggcaacaagagtgaaaactccatctca

SEQ ID NO: 390510 - DNA, 259 bp, Homo sapiens
atagcgttgatgagtccatttctgtggctcctttctgggtataaacctgagacgggcccattacccaggacacacaccatcagtgtctctggcctgaacagggccatttccaaagcaagccaagcccagaatccagggggagaggccatgagccccagaagcatcctggaatgtcaggccacttggccacacagagcactgggcccaccctagctcatccagctcgagcagtggacagtgtctgccacagaactcctaa

SEQ ID NO: 390511 - DNA, 387 bp, Homo sapiens
agagcttccaacccagccaatttgggagaaatgatgagcaaggcctgagggagtgagactgcgagagaggaagcctggcacgcgcagttgcacatcacttattcctgccagactctttcttccctatctgtaagatgggaggttgggctcgctctgtatgttattgagctggttgtctctttgacatctataagaaaagtttcttcaagatccaagtatatacaattcggtgaagcagagtgtgctgacccagtaagaagttgtgtgagagaagggatgtcttaacagccatctcgctgaaacggccatgcaggcacccaccagcttagggtattgcggctgctgggagttggcctctgtgattcaagcatccctttgacccaaggc

SEQ ID NO: 390512 - DNA, 293 bp, Homo sapiens
ggcctttactgtctgtatttctgtcagcactttggccacaaccgctcacacagtctaataaatcccaaactttcccttatcttcctgttttcttctgagccttctaaactcttccaacttttgcccattacccagttccaaagccacttccacattttcaagtatctttatagcaaccaccctctccttggtaccagttgtcttccttagttcatttgtgttgctataaatgcctgaggctttgtaacttgaaaagaaattttatttggctcacagttctgcagcctgtacaa

SEQ ID NO: 390513 - DNA, 345 bp, Homo sapiens
gctgcagtgagcatgattgtgccattgccctctacctctagcttgggtgacagagcaagtctctgtctccaaaaagaaaaaaaaaaaactatcttaactcataagctgttctccaaccttattttatcatcctcatgaaattctttatctttgcaaaatttgtaatttgactttgcacttgatttgcatggtgttattggtagattccaagtctctccttgagagactaatcagtaaatgacaaattggtgataactgttaagctgggagaggtgtctgaagaggaactacattaatgatttagttactttagtagtagcattagtactgttgcttcttttaaag

SEQ ID NO: 390514 - DNA, 469 bp, Homo sapiens
ccccttaccagtcgagcattcctagaggaaggtcatagaccagttaaactccaccattttgccttgcactgcacatccttgagcccaatcacccaactcctgagatcttatcaggaaactgctaatcaccagattctacctattaggagactgacctttccctggatttggctgtgaccaattactattttagagagacagtttaacaacctcctgaacatcacctgatagtcctctgacattccttgggaggtgagagggccgtctcccatcctgctcatctctgccctactatctactgtaacagttaggtgcctacatttcctaagtactggttactcagtttctcccagattcccatgaaattgagagctagattgatgtggcttccattccttgaaaccaaaagaattctcaccattcattttcacatgtctacagcaaggcagaaatattccattctaggaca

SEQ ID NO: 390515 - DNA, 363 bp, Homo sapiens
gaaagtaccaaatgaacagaataaacagaacgtgttgagagcagattcatttcaaggtacagtgggccagaaaggcactaccacctgttctcaacttttacttacagattgcaatcacgtggacagctcttgaaaattcagatctccaggtcttgtcccagctcaatttattgaaatcttccagggaggtgctgagcatgggtaatttttaaaagctgcccaggtgattccagtgtacaaccagggtcaagactggctggagtacagtggaagaggtagccttactgctggcacactaaacatagggtttttcttccccaaaagaaaaagtaagacaattatgttctactgatcagtactcac

SEQ ID NO: 390516 - DNA, 879 bp, Homo sapiens
  misc_feature (774)..(774): n is a, c, g, or t
  misc_feature (777)..(777): n is a, c, g, or t
  misc_feature (803)..(803): n is a, c, g, or t
  misc_feature (805)..(805): n is a, c, g, or t
ggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggncanaggtggaggtcatctcaggaagctgngnctgggctatcgtgcccgttacgtgagtgccagtgcccgagccatcctggaagaacagggcgggctagcctggct

SEQ ID NO: 390517 - DNA, 311 bp, Homo sapiens
ttctcagcctacaagttcctgttcaaacctaatgtctttcacgaagtcttcccttccctgatcctcagccactcatcataacaaaacatttattgcatgctcactctataccaggtacagtagatgtaatggaggtgggaacagagacagtgtcagttatatagggcttgcagtctgggtgtgtgcatgtcagccagagacaagtataattttacacctgtcatgaggagctataagatagggccgagggccgggcaccgtggcttactcctgtaatcccagcactttgggaggccgaggtgggcaggtca

SEQ ID NO: 390518 - DNA, 763 bp, Homo sapiens
agcccacttcctcaggctgggaacggcctctgggcccagccccttccccttcccccgggacttcctcctggttaatgagtagtcaaagcacctgggaaatgaggctcctgctgccgtgaggctggaatgtgagttctgcttccagatagagtcttgtgcaaggggccctgcctgggatgggctgttacaggcagtaaacagaggttgccaatgttcctctttttgaggcttgctgatgtatttgcgcttgggagcccattttatagaaaaggctgagaggcagatttgccctcagacttatctgatgctcctccaagcagccctcttggcttaacactttctgaaagggctcctcggccccctgacatggcaggggtgtctagaggaacagggtggaagaacagaccttgtcagctctgaagtctgagcactgctaggtgtgcgccctcctcactgggcacgtcacttgagggctctgaccttcaggttctcatctgagaaggggcatgatgcggacatgggaatgtgtgttagttgttcagcagagcctgaactattaatggaccagcccaaaaaagtattgctgacagggggcaacccatgtagtggagtccatggagctggggagtcaggcagtccctagttcaaatctctgttccagccctgccggcttcgtgacctggaggagtcacagaactaccctgagcctcaggtaacccacccctgaaatggagcaatagtggcacccaggagggttagaaag

SEQ ID NO: 390519 - DNA, 239 bp, Homo sapiens
tccacaaagaggcctcttctgaccattccactctcacacccaggcctcctgtctccttttcctgctcatttttctccatagcacttaccatcctctgatactatatattttaaccatttcgtttgctctctttctctcctgctaatacgtaagctccatgagggcagagacctttattgattttgttcactatcccatcccagcatttagaacaatgcctggctccaagtaggcactca

SEQ ID NO: 390520 - DNA, 377 bp, Homo sapiens
tctatacttattaatggtaatactgttttccctgcacccattttggaatttttcatctcttcatttacctatctatgtattggcaccaaatactttaaataacttcctcataaagtttttcatgttgtcttattttcaaattcccattgctttggttttggtcattagtagattatgcctaaattattacaacaaccttcttagattctgtctatagtcctttattttcaagcaccatcttgtaccccaccaccagattaatcttatcaaacatcacattccccaggcaatcttccagtccacagtccagtgactatctgctacttaagatagaggctttagcaataaattctgttttttcacaatctagtcagtat

SEQ ID NO: 390521 - DNA, 228 bp, Homo sapiens
gcattctgtccttgatccttggctcttttttgtggcactcatttcccagataccccatctatgctcatcaactcattttttccatactgatgattctggatcatttctccttggccctgactttgccaccaggcacatatttctgagtgacgtacaggcacctccaacttagtgagcagaagcctccatgagccctcagcctttctgacccctcttactcctgctgag

SEQ ID NO: 390522 - DNA, 421 bp, Homo sapiens
atctgtggttcttagcattgctgtcagctagaggcacttgggctaacctccttagctttggtttcctcctctgcgatgtaaggaggcttgaactgcagtacctctaggtggtccttccagctctaagcttgagaacttaagtttattttagctgaagaagagagatagaaagccccttgaggacaggaaccagcttgtatttcccacagcacctactggtactttgctcctatgggctcctgaatatttaattaatgaaacctcttgttactgtttgaaagctcactacttgtattaacctttcctgagtattcttggactctgatccagttttttctatatcacctcttattgtacgaattgtatgtcactttcacgttttgttttattctttatgtgcttcatttacttatttattgct

SEQ ID NO: 390523 - DNA, 356 bp, Homo sapiens
atttttgctttgagaagctacgtatagtttttaaaaactgggttgaggaagacagtcctttgtatttacccacataattaccatttctgctgctcttcactacttgagtatttacatttctatctgataccattcccctcagcctgaggaatttccttcagcatttctctaatgccaattttctggtgaagaattcttttagctctcatttatctgaaaatgtcttaatttcatcttcattttatggatatttttcactgggtataaaattcttttctttaagaatgttgaatattggcccccactctcttctggcttgtagggtttctgccgagagatccactgttagtctgatg

SEQ ID NO: 390524 - DNA, 481 bp, Homo sapiens
gaagaggtaggtcaaagagaaaataaaaagtgagatatcagcaataccaataaatataaatggattaaatatgctacataaaacactaagattattggccttaaaaaaagcaatttgttgtcttaaaaattacagttgtattcagaaatattgaaattgagtgaaaaataacataacaaaaaatttatctatatacattaatatcatgaaaattcaattttaaggtaaaacaaatagcattaagaaagaaagagatgtatattttataatggcaaaggtgtataattgaatgattgtattggtaacctcaactgtgcatttccaccagtatccatgtcctttgctgtgactgtgaaattcatttaactaatttgttcgagtatattttcccagccctaaatttgggcttactgctattaattgtcttagccaaaaataatgttagcagctttaacataaataaaaccttgatgaagtgttt

SEQ ID NO: 390525 - DNA, 761 bp, Homo sapiens
gtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggccagaaaacctctgtgcctggcaccggtcaccttcccagcttcgcccactccctgcgctaaagtggacccgctcattgttccttgacaagctccatgctgctgcacagatgtctttttctcctgcttccttcctggcagctccaggcactcctccagccatgtttgtggaccagctagtgatgagggccacggtcactggggtcttcttctttcttccttgtctgattctccagtagacc

SEQ ID NO: 390526 - DNA, 261 bp, Homo sapiens
taaaaccacatatcccctgattttctgtacaatcctgatttatctgcccccacattaaccttatctgactgttctaaccactgcacatacaggtaatattaatcagctttttttttttttttctgagatggagtctcactctgccgccccggctggaatacagtgatgtgatcgcggctcactgcaacctccacctcccaggttcaagccattttcctgcctcagcctcctaagtagctgagattacaagtgcccgccacc

SEQ ID NO: 390527 - DNA, 394 bp, Homo sapiens
gcgcagagtcgacagctctacagtatatctaggctggatatagagtgcacgacagacccttcttttctagtgggaagcattgggtgggaagttagtcctttctagccttaaaatgctgtgattctgtcatctgaagaatgggcaccaacttctgcttgggattgttttgaggatcaaatgagaaagcactttaaagattataaaacacacttaccttgtttattatgaatacttctctccccccttggttttgccccccttggttttgacttaggttttttaaaagtttaaaattgaattgtaccaataggagtatgaactaatgatcccagggtttaggtagatttggggacttaaatctttcaataagtgatcctttagctagattgggatg

SEQ ID NO: 390528 - DNA, 198 bp, Homo sapiens
gaaatgtatatgaattactttttaagatatgaaaaaatgtgttggtgaaatgtttagttctgtatttttataagtggattcttactctatttaacttaggagtaaaaacatactgtgaaatgtacatatgataatataaagttcacctgcctagtatcctgttctagaaattcaagtaggaacaagcttggaatattc

SEQ ID NO: 390529 - DNA, 184 bp, Homo sapiens
aagagaagcatctaagatagaaggcagggcctcaggaaggggcagagactagactggggacctggatagaaaggaggagcctgagaaagaaggctcaggaagggggtagtgctctgtgggaaggagcctggggtcaggagggctggctatgggaggggtgggaccatgggggaggggctatggg

SEQ ID NO: 390530 - DNA, 308 bp, Homo sapiens
cacatatgtgtgccctgcagagcacagcaagtgttaccatagccctgagaaaagaaaggatgatttgaactggagagacagacaaagacctcatgataatagttgtttatgtagtccctttcataaatctcttcacagatcatacagtccctccacagatcactggcccacacactcttgcatcccattctcacagtagccctatgggagataataccatgatgtctctacttcatatggaagaagttaaagttcagaggagtgaggtaacttgcccaagagtataactaacaggggacagatctggg

SEQ ID NO: 390531 - DNA, 761 bp, Homo sapiens
aacagggagatagcccatatgcagctactgcaataatcaaggtgaaaatgggggtgataagaaggggccatattctgaatctgttttgaggctagagccaacagaatcacagccagaccagatataggatgtaagggaagtaacagggacaacatcagattttttggtctgaacaatgaaagatgaagcttccatctgcaatgaagagaaggactggagaaggagccggttagggaaggatcatcaggatctcagttttggacaggcttgaacatccgagtgagatttgtgtgtacaaaatatgggaagtgtgacactgtgttaactcacggcgaggatggggaaactctgtgtcaccacggtcacgggggggacaggcaacgggctgggagatcatgtcggggacatttcagcaggatgagatacctgtgccactctggggagagacagaggagaacgacatttgaagcacggagtgaaagttcagatccacagtcagtctgaggcacctttcatccaagagctggggttggggtggctcccgagagttccacgaactttgttggcacacaggaggcacgagggtcacatatctgtgcccaccgtggggtgagtggcgatcctcagagatggggctcgacttttttcctgtgttaccgcattaccggctgtacgattgactgtgagaaccggtaccttgttgtggaaactgcgaactggcgcatggttcacatgcccagggatgtccctttttgtacccc

SEQ ID NO: 390532 - DNA, 420 bp, Homo sapiens
atgtgactaatctgagtttcttccaccaagcatgttagttaggggtggaggactagaacctagaaccctgaattcgagcctggaagatatgtaagccacatgctattgagatcgtggtcatgggacacccgctaacacaaaccttctggtaggaagtttttgagaagactgggtccaatatccccaagctaaaatcccactggcccatcgctgtgtttgctcagaaaaggaatctgggttctttggtttctgctttccagttgaccctggttgctcctctgttttacggcattttgggagtcggtctcccagagcagcgctgattgtaatgagaagcgcgttccctctctgggggacaggagcagtgggagaaaaatgggcctgggaaagagctcctccaaataaaacttattagacaga

SEQ ID NO: 390533 - DNA, 157 bp, Homo sapiens
ctagaatactccatcttttggagggctggcagatgagagggtgcctgcaaatgaggctcagaagttattactggggagtattctgaaggtgtgggtttctgaggtctcagcaagtaatttgataggataatttataatggaagaacagaatatggaa

SEQ ID NO: 390534 - DNA, 362 bp, Homo sapiens
caagaaaacacatcctaatcaccaacaaacataagcttctgcagtcacactctgatgtgataaattagaattctgctctacagaagccaacacagtatggatgagttgagagttatttttaatgttaacctagaatggtaaagcatcagaatgtttgagcctaagctgtacagaggcaatacaaaattctattactgtagaattctaattttcctttagacacaattcttttacattttaactatatcttcctgtactttatcccaagagcaatgcagagttattaaaatgctttgagtggaagactgaagtgatagagatggtctttatgtaaaaggtatctggaagcaatgctcagacta

SEQ ID NO: 390535 - DNA, 378 bp, Homo sapiens
gcaggccagaaatccaaatagttcccttcctgcttggatggtctaaccaaccgggcatggactgtacagtagctctcttccagcaccccacagcctggggtaataagtcatgcaccagtctctcactgcttttcccaaaagtcaaagacttccctgtgggtcagcccccaagggccatctggctcctggcctctgatgccaattttacctcttgtctctcatgacggggaaaacttacatctttcaggaatctaacgggatgcagtgaatccgagccttttcgagagctcaccaatcagactgcccttgtctatccacaagcagatgtttggtggtattgtggaggacctctactgggtatgctgccaaataattgga

SEQ ID NO: 390536 - DNA, 274 bp, Homo sapiens
catccagactccctggtgagccccgtgggcgctaacatctgagaagcatggctctgcaaaggtgtcttgtccactgaatttgttgaagtcatttcactgatttcagcccacaactggggcatctttatcaaagcccagggtgctccacaagccatcaggcctggggcaggtgggggccctcccctctcccaggagaggcctagccactggcattcctgcaggagcgcgtgcagacctcagggagactcatgaaatgctggtcactgtgcactgg

SEQ ID NO: 390537 - DNA, 611 bp, Homo sapiens
gtgaaatctataaaatacttaaggaagatataataccaatcttacaaaaatctttacaaaaaagaagtaagatggtatccttccaataaattttatgagaccagcatagccttgacattaaaaccatgcaatgacattacaaataacattgcaaactttcatgtacataggcaaaaacacttaagaaaatattagcaaatcaaatctagtgatataaaatgtatgatacattatgatcaaagtcatttcttctcctaggaatgtaaagtgtaaatactaaaaatcaaatggtgtaattcactgtattagtagattactgtattaatagattgaaagggtaacaccatatgattatctcaatagatgcataaacaagcatttgacaaagttcaatactcattcatgatttaaaaactcaataaattggatggaaattccccaaactgataaagtatatgtataggaatcctataattaacctcacatttaatagcaaaaggtaatttcctctaccaatatcaggaataaggcaaggatgtctgccctgttttattcaatatcatcttggaggtttaagccagtgtgataaggcaagaaaaataagtgaaagg

SEQ ID NO: 390538 - DNA, 151 bp, Homo sapiens
aagaaataagacaagcaaaaatccaaaaagtgacaaaagctctacccaatgagggggtcagtcccatctaagtaatgcaaaaatgggattggcttgaggaagtaggaatgggaacccagtactgaagttataggccaaatcaaaagatggg

SEQ ID NO: 390539 - DNA, 378 bp, Homo sapiens
cccaggctagagtgcaatggcgctatctcggctcactgcaagctccgcctcccaggttcatgccattctcctgcctcagcctcctgagtagctgggattacaggtgcccgccaccacgcccggctaattttttggtatttttagtagagacggggtttcaccatcttggccaggatggtctcaaactcctgaccttgtgatccaccctcctcggcctcccaaagtgctgggattataggcgtgagccactgcgcccagccacggatttttctctctcatttcccgtctgtgcccagccttccagccagcccactatcgccaaatcgccccaagtaccttctagcccagcggaggagagagcctgctctttcttttttc

SEQ ID NO: 390540 - DNA, 447 bp, Homo sapiens
aataaaaggtagtattttattacaggtaatttgcattcttcattaagaatatatattaattttatcccttagatttttatattcttgtcatcaaaatcctctttctgctgtttctaagagtgagaaaatgctctcaactgaagttaggcaggtcacatgtgaatactgagctttaaaccaaatgaatcatggtacaatctaatttcttcctgatgtgagttgactcttgaattcattgttaccataaatagggtattcttgtgacatattaatatgaccagagcgaggcacctatctttgaggaagttagttttaagatggtcattgtcctcttacacctgccccaagtaaatgacttacgaagcagattttttttaaagacaaaatcatttggtttgtggacattaccaattattatgtttgtaagacttaactccatacatccct

SEQ ID NO: 390541 - DNA, 449 bp, Homo sapiens
agatgatgttttctgggaattcttagacttcaatgtttcaatcctgctcctataactcaaaccaaaaagttgggggtgtatttggtcttagaagggattattgagtttttgatgggagaaaatatttaagatgaaacagtaacatacatctgcaggattaagtgttaaatttttaaatcagtgaaattgtatataatttttttaatggtataaagtactgaagttggcatattaaagaacattgaattttgagatggaagaattagattctagtcccatttctttttatatcttaataaactgacttttgtcaaacaattaaaaatgagaccgaggttttcctctagacataaacaagttgcacccagcttgtgggttttttgagcaaattgcaggggaggggatgcacagaaaatgagtgacagatggctgggtgtgatggctcacac

SEQ ID NO: 390542 - DNA, 454 bp, Homo sapiens
gcaggagccagggactggagtaagaaagcttacatgccaaccttgcattctcctctactgtagctgaactggccctcaaaccatagcacattctttctcactcttccctgtgctttccataggcagaggttcttcattccatggctaacatcatcacagctcttggatctccagtaagcttgtgatgaatgctgccaggtctgcaacttactcttcagggaagagggctcccttgtggcccagggcaggtccagaaatgctaagagccatgacccagaattggaaacaccaacagcccagcttggtgctctacaccactgtgccaagctattacctaagctgcaagaaaaagtcccctttacttttccctcccctcccctccactcacttccctccttccttccttccttccttccttccttccttccttccttccttccttccttccttcctt

SEQ ID NO: 390543 - DNA, 870 bp, Homo sapiens
cctatcctatctgcagcctctagtccaaggctcccaagggccccacgatatctgatgcatcttagcacagagcaagctaatgccgactcatgccacatccccgttacacacaagaggtcagagaggaagcagggcagagcagttttcctctgagccagacctcagaggtggccgtggtatttttgttttcccttccaccaaacaaaaggatctgtgtaaagcaaggcatcatcttactgcaaggggagacatcgctggggtctggttagaagatctggctctattttctccaatgaaggtctttataggaaatctgcattagtgccttgtccatgttcatagaccctctgcttcatggcagaagggcgctgacttgaaggcccctaagcagcgaaggaaggggagcctctgtcccctccctagctggcttccctggcacatgctggtttccctccaattctgtggtgcacatcatgaccagcagaggaaagaattcagctggaccacctcaagctctgtgtgacggagttgaaagctttgctgatgtatatgttggtggtcaaggaaggctttctgaacacttacctggtgcccacagaggctctgagagctggaagctggaaagagtcagtctggggtcctaaaaggtatcttctcttcagtgccaacatcaggggcatattggtgatagaaacagggtctctgcatggctacaggcaccattaattggttcagttttcttccatttctcctgagctcaccctgaccctatgcactgctgaccaggaattctaacccgcagcatcgtgggtgggcccaccttgcagcctcatcacggttgagtttgttactcttattgatgaagaaact

SEQ ID NO: 390544 - DNA, 113 bp, Homo sapiens
tcaacaacaggcctgtccagatgtgatttaattcaaagcctgattacctttttctctttttactcttataattggaatgttgttgatcagattctgcttctaataaaaatggc

SEQ ID NO: 390545 - DNA, 286 bp, Homo sapiens
gcttggaatctaatgaatgctctgcagtcaccatatgaaattcttaatcatttttccttcaaattcgtgtattgtaagtgaagtgcaataacacagtggatgcttgagagcttggactcttgtctcaccccggtcgcgtctcctgcgtcttcctgggacaggttctgggcccccacccggcgaacaccgctgccctccgccctgggcagtggccggccacggacgtgggggcggcgcagacctcggcgtacagccaagggacctcgccgccacgctgggtcgcctg

SEQ ID NO: 390546 - DNA, 277 bp, Homo sapiens
tgtgtggctaagccatagccctgactaaatccagcgctccatattactacattcctgaacttatggtggtgaacatactaaagtaaaacaaaaccaaacattgaaaaatcaaaaattcaaagtgtgactaaatcatgaagaatagatgtagttcaaatgtatagtcactgaccttcgatacttccagaaaatgataggagtctattccctctcctcctctgctagctaaccattttagagattccctagtcaagcttccaacaatgctccattgccc

SEQ ID NO: 390547 - DNA, 196 bp, Homo sapiens
tgcaaccatgcacccttgtctagattgacaaccctgaaaggcaacctttctgggtacttgcatgaagcattcacagttgaaaaacagctgtcagtgagcctgctctgtttctcaagatggtgggagcctgctttatcactcagaagcaccacgtgcattctgtgcacctttcccgtcattgactggaattagtttc

SEQ ID NO: 390548 - DNA, 366 bp, Homo sapiens
ctgtagcctcagctacaggggaggctgaggcaagaggatcccttgagcccaggaggttgaggctgcagtgagccatgattgcaccattgcactccagcttgggccagagagttgagaccctatctctaaaaaaaattaaagtaataaaatatcattacattcttgtaccgctttatagtttagaatgtatttcacatattccctgtgtgcctctcataatcctccaagacaaggcagctattaactcatttttatggatgaataagctgaaacatgcagaaataacttgctaaaggtggaaacaatccaaatgtctatcagctgatgaatggataaataaaatatggtgtatccataaatgggata

SEQ ID NO: 390549 - DNA, 152 bp, Homo sapiens
agttcccatttcacctgctctttaatattgtcaactcccctgctagctccaaatttccagtaatttcatattttttttgtttgtttgaatcaggatccaaataaacaaaaaaaatatgaaattactggaaatttggagctagcaggtgaatg

SEQ ID NO: 390550 - DNA, 327 bp, Homo sapiens
ccctttgccttatgaccctccatcgaattctttcttctgaggagtcgagaattgaggttgctgcagacccgtacagatttgccactagcaggaagaccagaagttgcaacagctgcaggcagagagtaggggtgaggtgctcagtgcaaagagaattctggtggcaaggggatccttgatctgtggtggtgtgtgaccactctgggcagtgatccaaaaaattgaattcacacacactcacttcttcctggagcaagcagaacaaatgtttcttgcatcctgctcagctccagccctcctcaagctccaaccaccccccaccacacc

SEQ ID NO: 390551 - DNA, 107 bp, Homo sapiens
accgaacattaaacacagaaccaattctagtcaaagtctttaaacaaattgaagatgacggaatacttctaaacttattttataaggccaggattactgagatacca

SEQ ID NO: 390552 - DNA, 759 bp, Homo sapiens
aaacttccaacgaccagagatattcagacagccattactaagaaggaacaaagtaaagatggttttaaaagacaaatcttatgtagtcttcaagtaatacttagttcttgtatattgtgctacggtttgaatgtgtcctctccaaaattcaggtgttaatacttactggccaatgtaaagatattaagaggtggggtctttaagaggtgattaggtcatgagggttcctcctttcctgaatgggattaggcccccttataagaagcttaatggagggattttgttctgcttgcccttctgtcttctgccatgtgaagacacaatgttcctcccctctggaggggatacagcaacaagctgccatcttggaaacagagagcagccctcaccagacaactgaacctgttggtgccttgatcttggacttcccagcctccaaaactgtgaaaaaatacatttctgctctttataaatttcccagtctgtgatattctgtgataggagcacaaaacagactaagacaatatgtaactatataatatagtttaatattattcttggttctgaggtctagaatagtacttaacaaatttaacaagaaatgtgtaagacctatatgaggaagatgacaaaactataaaggcaaaataagatctgaataaatggagacaccacttatctgcttggaaaagcatgtaaacatgtccattctcttgagataatatataaattgtaatgcaaaaccgtgttatttcttaa

SEQ ID NO: 390553 - DNA, 446 bp, Homo sapiens
ttcagaaggaagggaaggctgtgcagtgcactcagcattttaatgctactgcaattgctgcaatcatttcttagggttacttctgtcctaattttccccaaatctgctgcacagatgcggcaactgtcccaagcatctctggcctaacagatttatgcacctagcaatttgcatctagcaggttcgagatagtgtgtctctagtgggccatgccagctggtcagctatgttgacctgcacgggttgtggagacctcacttctagttggtgtggtccaaggagcctggtcttcctggatgtgtggcattcaccagcacatgcagaagaagggagagtgcacctcatttaatagtggccagggctatagcaacacctttctagggagtggagagggccaaaggatcccagacttgtcaagaatgatccttttgataaattgcaagtca

SEQ ID NO: 390554 - DNA, 291 bp, Homo sapiens
aatttgtggtacacgattaaagcttaggtcagaaaagaagaaagttttcaaatcagcgatataataatttccaacttaagaaactagaagagcaaattgaaccaaagcaggcagaatggaagaaagaataagataagaaaatcaatgaaattaaaagcaacagaaactaaggccaggtgcagtggctcatgcctgtaatcccaacacttcgggaggccgaggtgggcaggtcacgtgaggtcaggagtttgagaccagcctaaccatcatggcaaaaccatctctactaaa

SEQ ID NO: 390555 - DNA, 462 bp, Homo sapiens
gccgtctaggattttttatattggagaccagtctgatgagtagcccttgagcagggactggattctaagtcttggagaaaatgagtaagttctacctcttatgtgaggtatgattgaagaaattgtgttttctttgttttttgagaggcagggtcttgccctgttgcctacctggagtgtggtggcataatcatagctcacttcagtcttgacctcctagggtcaagcaatcctcccacctcagcctcctgagtagctgggactactagcacgtgccactatgcccagctaatttttaaatttttttgtagcgatgtggtcttggctatgttgcccaggctggtcttgaactcctgacctcaggtgatccgcccccctcaactcccaaagtgctggaatcacaggtgtgagccaccgcgcccggcccaactttcatttcttttgcgtatgtacccagaagta

SEQ ID NO: 390556 - DNA, 392 bp, Homo sapiens
catagcagcaaataaatatgacagaatccattcattcaacacacactgacttagcatcttcaatgtgccagactccttcccaagaactgaaagaacatcagtgaatagacagacaagcatccttgtccttagagagacaacaaacaagatgaatcagtgaaatatataacataggacacagtgacaagcactcaagagaaaaattaaacacagaaaagacatattaaaagtttagctaaagggccagggaaggtttcatagcaatgtgttaataacacagaggcatgaagaaaaggctgcagggacacaaagaaggaatgattccttcaagagaagctggggaagactccagagagggtgtggctcttgaggtaggttctgaaggatgacta

SEQ ID NO: 390557 - DNA, 1057 bp, Homo sapiens
cgcggtggctcacacctgtaatcccagcactttgggaggccgaggtgggcggatcacgaggtcaggagatcgagactgtcctagttaacacggtgaaaccctgtctctactacaaatacaaaaaattagcctggcgtggtggcgggtacctgcagtcccagctactcgggaggctgaggcaggagaatggcatgaacctgggaggcacaggttgcagtgagccgagatcgcagccactgcattccagcctggacaacagagcgagactctgtctcaaaaacaaaactaaaaaaccctattttcacatacagtcacattgggatttggagcttcaacatatgaattttcagggttatcattcagtccaaagtacttaatatgattcttttccgtttccacatagacaatcacataatctgtaaataatgactcttacttttccactttagtcgttaggttatacctatatatatattttcttgctttactggactaatttcaacctccagcacaccaccaatgaatagcagtaataccagcataattgtctgcagttctgctgagatacgtgctctattttattggcttggctgtaggtttttattttattttttgaagaggctaatctcttacaggaaaggtttctttttatatccagtttttacatgatgaatgatttcccagtatttcataattcatgaggctgaattcctcttgaatttattaaatgcttcctgtgcatcctctgtgatgatcatgtttatttactgctagaactcaagtacctagaactgttcctggccaatgatggtatgtaataaatacttcaatgaaatgatgtggtgatgcatgtctatagttctagctacttgggaggatggcctgaacccaggggttctagaccagcttagacaacatagcaagaccacatctcaaaaaacaaaaaacaaaacgaatgaatgaatgcatggaaggactcatctctaaaataaatgtggtcaggttgggtgtggtggctcatgcctgtaataccagcactttgggaggcagggatggg

SEQ ID NO: 390558 - DNA, 377 bp, Homo sapiens
ccctgggcccccctgcatctttatacagtggggggtgttgcccccccaaagggggtttaccccaccaaaaggaggggaaaccaacttggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390559 - DNA, 98 bp, Homo sapiens
gaaccttgagggggcactagttaactcttttccttttctctccacagaattggtctatttcacatcattttcttttttctttgatacctcctctcccc

SEQ ID NO: 390560 - DNA, 2158 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390561 - DNA, 2244 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatgttgctgtccccttttttcttccaactcagctcattccccaccttctctccctccctctccccgaccctgctctctttcatttcagatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390562 - DNA, 2098 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390563 - DNA, 1607 bp, Homo sapiens
ttgtttatctgggtggtttgagttgctgttgagaattgacctctgttgtccactcccagctctcacggcccctgggttaaaggtggtgggaatcacgcaggggttttcttcccctgtgaccatctgtatctgttccccttccttcatctccaccccaggttgctgtccccttttttcttccaactcagctcattccccaccttctctccctccctctccccgaccctgctctctttcatttcagatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390564 - DNA, 1401 bp, Homo sapiens
ttccaagacaggtccccgcaggcgttttgaaattcatcccaactgtaggctgagtgacctgaaggttggacagactgccgaagtccaaaagcttcagcatttccttagtgtcaggatctacttcaataatctcctgatccaaggctgagacctcaggaacataattgtctctcctttctctctcctcctcctgcagcttgatggagatacctcttactgggcctctctgaattcgcttcatcagatgcgtgacataacctgctatcttgttgcggagctttttgctggggataatggcgatctcctcgcacacgcgcttgttcgtgtggaagtcgttgcccaggcgcgtgtagtacttttctatgatgacccgggccgccttcttcacggttttggtgcgaacgcggcccatgttgcgcgggtcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390565 - DNA, 381 bp, Homo sapiens
ccagacccatgacaacagagagcatctagccatgatggaaaggatcttgggtcctatcccttcccggatgatccgaaagacaaggtgaaccttgagggggcactagttaactcttttccttttctctccacagaattggtctatttcacatcattttcttttttctttgatacctcctctccccccagttactttcagatggggaaataagggaattgtaacaagggtgaccttctgattcctcaacctccccttcccctctagaaagcagaaatatttttaccggggtcgcctggattgggatgagaacacatcagctgggcgctatgttcgtgagaactgcaaaccgctgcgggtgagctgggctcgggataaatagtg

SEQ ID NO: 390566 - DNA, 469 bp, Homo sapiens
tgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttga

SEQ ID NO: 390567 - DNA, 2035 bp, Homo sapiens
gcctggtggcgaattcggcacgaggctgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390568 - DNA, 2070 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390569 - DNA, 2616 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgacccccaaaaaatagaagactagatactaacacacggtacgaacgaacaaaaaaaaaaaagagagggggggggggcataacagagttaccccagggaggggccccaaggttgtagggaacacagttttttggcagacaggggggcccccaagaaagtggagggaccatagataacacgcaacagaagacacgcaggcgcagaaattacagacgactagagtagcaggcgaaacacagcgcaacacccaggaggagacactgaggaaaaagagagaaccaatataaagcagtagggagggaaaacaaaaagggggcaaaaaacatcctaatgaaagaaatatgaagagcaccaaccggaaaatatatagatattaaagaggtgttaatgtgggttaaaaacagcaggcatgattagcaatcgtagaaaaaatgggaaaagcggaatagttttaagaaactttttcg

SEQ ID NO: 390570 - DNA, 2098 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccaggtaagtgatgggatgtcttacttgactgcctggcattcttctacctggttcctttgttttctgctgaggacctgcctactcagttctccacattgcctgccttcctggcagctgatccttagcatgcccttttcagtcccatgctcactcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 390571 - DNA, 1718 bp, Homo sapiens
gtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttgtggctatttggagattaggcctttgggagataattagggttggatgaggtcatgaaggtggaaccctcgtgatgggataatggcttgataagaagaggaagagggagaggtcgctgtccctttccgccatgtaagcacacagcaggaaagcgactgtctacaagccaggaagagggcccttatcaggaaccaagtcggccaccactgtgatctgggactttgcagccttcagaactatggaaataaatgcctgttgctaaaaccaaa

SEQ ID NO: 390572 - DNA, 181 bp, Homo sapiens
ttgtggttcaaataagctgggttggaggagctgcacaggctggagccccaactccctcagcccactcaatccacctgaggtgcccacagacatcatctcgtatcagcccacagctgcctttaggggggccttgagaactcctcccaatagtaacccagactgggtggggatagtggggatg

SEQ ID NO: 390573 - DNA, 679 bp, Homo sapiens
ggcgattttgttgctgtacgaacaccacagaatgtactttgacgacctagatggtggagcctggacacacctcggctctgtggtgtggcctgctgcttccaggctgcaaacctgacagcatggggctgtactgaataccgcagaccattgtaattcatggggaaagcgcgaatgcagtcccccactacaacaaattatgcagtcgagttttccacatttgggaatatcacaggggtcagcacatccggagtgcaatcgatgagccccacgctgggaaaaaccaccttcgtgatcatggtatcttccctgccagagagaaaccaatcagcttcattttcaacttcttctatgactccagaggattcactttgcatcttgtgacaaatgaatatattacctgaaaaaaaaatgacaggatagattattcattctgaatgatcatgtggtcatcttctgcccatgaggaatagtaacgtaccacatgggggtgatgcccaagcactgcgtgagcataaacttcatgcaaagccgaattcctatgagacagaaaagcattgaggaataaaaacatcaatcaagataatgcacacaaaaatgtttcttaaaaatatgaggctttactagcaatggcagaatatttattgagagctcactgcttgcttactattttatctcattg

SEQ ID NO: 390574 - DNA, 572 bp, Homo sapiens
gcgaagagaacagagtcccaggtaggccaatagcccctcctctgcttaggaaaagccctgcccctctcctggccttgggcccctgggagctgctctttctaaaccttctgcagggacttggggtccagacccccatgttctagggtcagctcatctcctcccttgacatgtgaccgctgcagacccctcttctcagggcctcaggacagggaggccgacctgatggggagactgcttggctctggccacctccacagatgtggtcctaagactgggcatgggaccccaagatggcaacttgaggtcagcacaccccactcagctgtgggaaggggacagctcctccctggggtatgaagtggctgtcccctccaacccagcagtccctcctgtgggaacacggctcaggacctagctatcctggacatgcgcctgggttctaatagaggatgggttcaatcctgacccaccgttcaggccccgcagcggttcagaatcaagctggagttcattaatgataaggtatagtatgtgtaatgttgtccagtaataaaagctgactagaaaaccaa

SEQ ID NO: 390575 - DNA, 168 bp, Homo sapiens
atggggagctagttttcatctgaatgaagtcctgtttgggggaactgaaaggattaaactgatcctctagagtagtaagccttgaagatggaattccctgtcctttcttccagtagctgtctcggggggatgctttgcttgactgtttcctctgagcacccctgtctt

SEQ ID NO: 390576 - DNA, 167 bp, Homo sapiens
caggatacagagccccagaaccccatggggtcccagaggaggagcccagaggaggaagcgggaccatacctggaggggctgcctctgatctcctcagagactaggggtgcagtgggaggagaagataggagatgcctagagaccctggccccacagagatgcctgtg

SEQ ID NO: 390577 - DNA, 260 bp, Homo sapiens
ttgagattattcagctagtggggctggatatggtaaacaaggggaagagatgagtatcttttacatggaaaggaaaatatgagaaagctcaactcaaattattgctaggaattgtggtattacacatgggctcttaggctaatattttgattatctgctggcattttttacctattccatcctgttttactttaataagagtctgggccaggtgcaattcctcacaattcctagctgatatctacaggacgagctgatac

SEQ ID NO: 390578 - DNA, 468 bp, Homo sapiens
tcaacaaccaattgtgacaggaactaagagtgagaactcactcctggcagaatggcaccaagccattcatgagaaacccactcccatgatccaaacacctcccactatgctccacctccagcgctgggatgaaatttcaacatgaaacttggtagaaccaaacaaaccatatctaacctatagcaagttgttaggagagtttattggccaagtaccccattttatttactttggcattcctagtcacattggaaagcggcagcctatccgctattcctccccagtctcatccccaccttgccccattttatgactcacaagtaccaatatgttgctcactgcctttaaatgctcagtgacttcttatcatgggtgttgctgacccaatttatctttgcaaccagcattaaaaagcacagagcataatggtcagatggattttctataggtaactgcctgccatgactt

SEQ ID NO: 390579 - DNA, 695 bp, Homo sapiens
cgccgttgccaggcaacggggcggcgcaggcaggagggaacggctggttgcaggtttctctcgccctggtcccgcgcggccccgccgaggcggcgaccaaggtgggtgcggggactctcgggagccgtgggccaggcgcttagccggccacctcgggccctgtccaggcccaggcgttccagggctgctctgcgggccgcgtgcgagagggactctcgggaggccccggggcgccgcacccactccttcccacttgggactcccgcgggcgcccggctctcgctcctctggccagcgtgggcctcccaggccccctcgcggctctctccagagcaggagccccaccttgggccgcccctctcacacctgccgtgggtctggtacgcgcctctgtgtcggactccgcgcccgcctgcgtgggaggaagccaggactcccgggcgaccgggccattcctgtggtttgtgtcagttccacagcagcacgtgggcactttccaccgtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtga

SEQ ID NO: 390580 - DNA, 222 bp, Homo sapiens
agctaatctttgtatttttagtagagatggggtttcaccatgttagccaggctggtctcgaacccctgacctcgtgatccacccaccttggcctcccaaagttctgggattacaggcatgagctgccgtgcccagccatgtttctgaatttttaagtcaacttctgaataggcaaagaattctttttgtttttttgttcaactttagtgctataaatcgcca

SEQ ID NO: 390581 - DNA, 260 bp, Homo sapiens
caccagtgtcttcctctgggctttgggtgtcttctccctgatcttctccagacctttacactggccaggatcctgtcttgtatttgtattcctccttttaggtggatccccgcattgatattcagatgtgcttgtctccttccccttcataaacttccctttttttgagatggagtctcacatattgcccaggccagttgcagtgagccaagatcacgccactgcactctagcctgggcgacagatcaagactctgtctc

SEQ ID NO: 390582 - DNA, 133 bp, Homo sapiens
tggaaaagtacaagcttttaaattcccgtacaccttgtcaatttgaggtgaactggttcaaaagaaaaaggaacctacagaaatgtctacttttaaagttatcacttgaatagaatttaatgaatactagtgc

SEQ ID NO: 390583 - DNA, 525 bp, Homo sapiens
gaagtaggtgcgcctggagggagcaaggagctgacacaggagttcaggcagggacaaggatcaagtggaaatggtggagatggggcgagaggggcagactaggagatactgtggaggccgaggcatcgggacctggagagggactggacactgcactgggccaggtgccacacggcagggcagaggggaggggcagctctgggcagctagaggaagctggtgatgttcaccaggatcagagacagaacagctttacgagaaagggtcacagttcccccaagaagacaggaaaactactctggccatttgtccaaccaaaggctcacacacccacatcaaaactggccagcaatttgcacagcactttgcaaagcactctctgccagaaacacctttggccactccatctgctaaggtgaggaatactgagtccccattttaaagacgagcaaatcaaggttaagtggctttcccaaggccacaggaccaagtggtaacacaagaaactgggtcttctgcctccca

SEQ ID NO: 390584 - DNA, 433 bp, Homo sapiens
aaattagccaggcatggtggcaggcgcctgtaatctcagcttctcgggaggctgaggcagagaattgcttgaacacgggaggcagaagttgcagtgagccgagatcgcgccactgcagtccagcctgggcgacagagcaagactccgtctcaaacaaaacaaaacaaaaaaacagtatgtatttatttatacccaacctttccctaaaaagccttggttgcaacttcagatcaaagctaccactgtctttcagctagaaatccaaaagtttcctagacaacctctccatctcctttctcattctttccgacctgttttctgcatagcagccagaatgatcgcaaaatataaagcagacttccccccatcagggtgagctgtcagtcagcaagtctggcagggaaaggaggcagatagttgtaaatggcggtgt

SEQ ID NO: 390585 - DNA, 276 bp, Homo sapiens
aaattagccaggcatggtggcaggcgcctgtaatctcagcttctcgggaggctgaggcagagaattgcttgaacacgggaggcagaagttgcagtgagccgagatcgcgccactgcagtccagcctgggcgacagagcaagactccgtctcaaacaaaacaaaacaaaaaaacagtatgtatttatttatacccaacctttccctaaaaagccttggttgcaacttcagatcaaagccacgttaagacagctaaggcagggcatgtgaaaggtaga

SEQ ID NO: 390586 - DNA, 252 bp, Homo sapiens
aagaaaggagagctgcagtggctgcatgtgataactgctggcccctccctctgttctttacaaagcactttcactctcagcagcccagtagggggccagggtggcggatgaagaagtgcactctgggaagtggcttgcccagagtcatggggtagttggattctcccccagagctggagacacctcatctccctcctaggtgcctcctctgtagggggccttgtccccaggcagaagagcctgttgagttct

SEQ ID NO: 390587 - DNA, 459 bp, Homo sapiens
tagataaaatacagacacctcagcctccagttcagccactgtccagtcaagcaggaaagtacattgtgagtgagtcttaagtgaaaaggactagttatgatgcatttgagacaagaaagtagatcgagctttaggcttttccttttcttgccggaaaggaaaaaaacaacattgcattaatcatcatctggtcctcggccaagattcgtatttacctgttatgtgccatattcatactcaccctgtaatgtggcagcctcgtgccatttatcattccaacagcccataacagatgaggagacacagatgacttgtccagggtcatcaagcttgtcaatggcagagtgaatgttggagctcagaccttctgactctcaacccaatgagatacaaataaaatagtggaaaccaccagccagccctcccaagtgtttaggggcattaaagacactggccatc

SEQ ID NO: 390588 - DNA, 173 bp, Homo sapiens
gatgagaaaggcagttagagagcgggagcaagcgggatgaggaggggaccagcaagataggaaagaactcccccttggagggcactgttcattctcacccatccaaacaccgcaaagaaacctgtgctgactcactggatagtctggacccagcatgctcccctgaagactgt

SEQ ID NO: 390589 - DNA, 341 bp, Homo sapiens
cctcaggacgcttgcagaacccagccactttctccacttctgctgccacctccgtctctaaatgccactggcatttcctcatttctgccctgggctcccacagccacttctccactggatggccgagggatccttttacaatgcaaatcagatcatgtgactcctgcccagaaccctccagcggctgctcatccacagagtaaagcccagttcctcccagggctggtgagacctgcctcccactcccgctgacctcctgcctctcccctcatctgcccgtgaccctgtgtcacttggggtccttcagaacgcagggtacctcccatgcttgcctccccctt

SEQ ID NO: 390590 - DNA, 633 bp, Homo sapiens
atttggtgagctgcaatcccctcttccctaagcatggcctatgctgaggcttagatctccaggagtcccacagcttcccagggacctgctggtccactgtgcttaccaaagtcagagtgggttgtagggaacattttggggtgatctgggggtgtggtgactcaaaggcacattctcaagcagagcagtggccaccacagctgcacaagcagtatggtacctgtcatcttagttcaggtgtacagggagtgcagacatgcctgtgcaatctggcttcccagttctttgtcctctggaactccccaaatcattattgatagtgttgctgtgggtcacaagagcagaagtgtttctcaacagtttggcagtcagccaactgttgcaggggtgaagacagcagagatgtttttctgtctaccccttccgtgaggctctgagttcctcaggggttcatccctgccagactcttgctgctttccttttctgcaacccaacttctttctgtgggcactctaatgggtcctggcccacttccctcagttttccatgcataacttgtccattcaccagtaactgtgatcttctttctgaggagaactgacatccaatgtccctagttagacatcctgaaaa

SEQ ID NO: 390591 - DNA, 698 bp, Homo sapiens
cgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatata

SEQ ID NO: 390592 - DNA, 169 bp, Homo sapiens
aaggaggagaactgcaaattttgagagagtccaacaggaatcgctaactgcaggattcgctaactgaaggaatcgctaactgaaggggagactaagtacctggaagaaagcaagctcaaggactgtacatcatctctgcagctgcatttctttctttcttttttttttt

SEQ ID NO: 390593 - DNA, 307 bp, Homo sapiens
atcaaacaaaaataaaacaaaaataagtttaaaaaaatgaacaaagtctccaagaaatatgggattacataatcccatgaccaaacttaaaaatcactggtgtttctgaagaagaagaaaaaccaaaaagtctagaaaacctatctaagggaataattaaggaaaacttcactggccttgctagagatttaaacattcaagtacaagaagttcaaagaactcctgggagatccattgcaaaaaggacatcaccaaggcatttgtcatcaagctatttaaagtcaaagtgaagtaaagaatgataaga

SEQ ID NO: 390594 - DNA, 319 bp, Homo sapiens
attggttctgtggttattgaactgtgaatatgtaccttcctatcgtgagtcacataaagtgctttagcatttgtgccacgagatcctaaaacttgctatgttcggtctatgcttgtgcaccagaagctgttgatctataaggaaaagcagggagggatcgttgggaagggatgaggaggttggcactgggctgtggggagcggtgtgcagttttgttcatcagaggatgtggacttcatagcgatgttgtgttgtggggtttgtgttaggtgctcatagttggaggtaacgacgggatctcagaagccttgctctgctt

SEQ ID NO: 390595 - DNA, 327 bp, Homo sapiens
cacttattcaacgtggagcagaaaccagtgcatttttgtcagtataggctagcatcacagaagtgcaaaaaaaaaaaaaaatgacagtagactatagctcattttgattagtggacatttttacgatagacccttaattattcagtcactatttcactgctacttggaactgaccctgtttgtcttactcatccaggttgcatgccttccccttacttataaactctccatctagtggttttcccagatgctaaattcgccacctccccgccggccccggccccaagtaataaacaactaattaaaaatagaggaaattttggcaag

SEQ ID NO: 390596 - DNA, 311 bp, Homo sapiens
tctagagcaggatttatcaatcttagcgttattgacaatttggatgggacaagtcttcatgtgttaccctgtgtattgcaggatatttaccagaatccccagtccctgccccctacaggccaagagcatcatcacactctcccttcctacagtgggaataaaaaatgtctccaaacattgtttaatgtgttaaatgtgtccagaggactaaaactacctctggttgaggctcactattttagagggggaaaatacatgtaaattgtagtgagaaagaagttcatagaaaaggtttaaatacattgcatatt

SEQ ID NO: 390597 - DNA, 764 bp, Homo sapiens
gctttgggaggccagggcgggaagattgcttgaggcaggagaccagcctgggcaacatagagaaacccatctctacaaaaaaagtgataaataaaaatgcccacttatatatatagagggtgaacttgcagattctcataagtaacttacagttgtgtacataatgaagaattgacttgctttattagtgatcccaaaaaaggagcccgtttgttttatcttacaaatttttcataatttttttctttatttaaattttttttctataacacacaactttgtccagaaccctgtttgttaatattttagaatcgcttaaagatgtagtgacaggttggagtttacagagtaggtatcattgaagcatcactcagttttttaacacttatttttcagtaatgaaattggcagttactgagttatcagacagctcttgtttgagatgagctaaaagatctacagttgatattactggtcatatattgcaattttgtgtttcagagaatattctaaaaaacctaatcactgtagacaggatgcactgggatatagatagttactaactggaccaacttttctcacacacaaattagcactttttctaagaatactgtttattaccccaaaattttactgtacatactccaatcattgccttgcagaagagcatctaagacctgtcattgcttcgtactgagcacaaattatttttcaacttaaaaataagagtcctggttaatagagataggttgacagaatgtcag

SEQ ID NO: 390598 - DNA, 422 bp, Homo sapiens
tttgttttaattttcagaagaatattttacaatagcttatatttgttgaatttttacatacctgaaaatgtcatttttctatctttttcaatgatagatttgtatgactgggcatagaacccttgtggaaaattattgtgagttctagtcccaatttgactctctttcctttgcatttggcttccccaacacatttggaagctttttagaatcttctctttatctctgtggttctaaaattgtataacagtgtatcttaccttattcattttctcggttattctatggcctctttcaccttggaggcttatgttttcagtatttagatactcactcgaattattttcctttctttaatataacttcttctcctttgtgttctctactcttatttttctgcagttcttactagttcagtgtta

SEQ ID NO: 390599 - DNA, 587 bp, Homo sapiens
cacactacagtcatgtagtaacttctcccttcaaataccttttaaaattctatttggtatcaaaaagaatcaaaaatcaggaaagacatacaggagaagaaacctctagtcatgagagctcccttctacagagagagatgacaaattctgtctccactctgagtgagaaaacatgccaaccacccaaagcaactgttcctagcctttggagaaactcctttgagaatctgatgaaagctctacctttgtccggaaaagtgtcagtctgcacagagacacaaaatactccctggaatttcaagagggtcaagggccctctaaaactcacccactgaccacaagataagagccatcaacaaagagccatctgtgatactctttaaactggtaaaatcctcaattcagattttgtttccttaaggtgcaataaacttaaaagcctatgcaaagacctcaagaaggtacactaagaaagaagtttctcattcagttcttcctgtcttttttttgagatggagttttgctctgtacccaggatggagtgcagtggtgcaatctcagctcactgcaacctccgccgcatgggt

SEQ ID NO: 390600 - DNA, 1017 bp, Homo sapiens
tggttaaaagaccaatgtttcctagtaaatattcatctactgatagttactaactgctgaaaacaacaaaactggctttgaatatttttactgattggcctctacactttttggttcacattccgctagcaagaaaatcttgtgcctacacccccatataatgtgctcttgcatcaatgttatgtacatcctgaaatagaaaatatagaacaaagtttcaaatatgcaataaacaggaaataaaaaatatttaatttttttttttagatggagtctcactgtgtcgccaggctggagtgcagggacacgatctcggttcactgcaacctctgactccttggttcaagtgattctcctgcctcagcctcctgtgtagctgggattacagacacgtgccaccacacccagctagtttttgtatttttagtagagacggggtttcaccatcttggccaggatggtctcaatctcttaaccttgtgatctgtccgcctcaacctcccaaagtgctggaattacagctgtgagtcaccgtgtctggcctaaaattgtttgtcttatgtactcaagtgccaacaaaccattttgctagcacagtagcagtaatggagtaagagcaatatgctggaatatacttgatcaattttgaaaatctttactttatgatattacagttcaaaagcaggttcaaagtttatacttgttttaacagctataatattaataattggcaatgatctaaatagaataaatgcgtctttggatgtgcctattaagtcaatactaattttttagtcccacctcctagctgttcaaagtgttttttctttgatatttatttaattaatcctcttggcaagtggcactggtttattttaaaataaaatacaaaaaataggctagtgtagtggctcactcctgtaatcccagaactttgagaggccaatgcaggcagatcacttgaggccagagttcgagaccagcctggccaacatggcgaaacctcatctctaccac

SEQ ID NO: 390601 - DNA, 607 bp, Homo sapiens
tggttaaaagaccaatgtttcctagtaaatattcatctactgatagttactaactgctgaaaacaacaaaactggctttgaatatttttactgattggcctctacactttttggttcacattccgctagcaagaaaatcttgtgcctacacccccatataatgtgctcttgcatcaatgttatgtacatcctgaaatagaaaatatagaacaaagtttcaaatatgcaataaacaggaaataaaaaatatttaatttttttttttagatggagtctcactgtgtcgccaggctggagtgcagggacacgatctcggttcactgcaacctctgactccttggttcaagtgattctcctgcctcagcctcctgtgtagctgggattacagacacgtgccaccacacccagctagtttttgtatttttagtagagacggggtttcaccatcttggccaggatggtctccaactcctgagctcaagctatccgcccacctccgcctcccagagtgttgggattacgggcagtgagccaccagcctggcccctcttttcactttgaaaggtaatgtttaggtttaaagacattacttttgtgtgtctatgta

SEQ ID NO: 390602 - DNA, 379 bp, Homo sapiens
cctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgag

SEQ ID NO: 390603 - DNA, 644 bp, Homo sapiens
atgagagactagcattgcatgaaaagggcatgccaggtactgcagcatgaatgacagggctcgatgtgggtggggaatggtgagtagtttggagtggtgaaattttaggtgatgagatgaaaagtggtaggagatgagactaaaagagaggttgaggccatgtggtgaaaggcctcacatgctaaggacttgactcgataagcaagtcaagtggagaatgacatgattagatttgtagtctttggcattaactgggcagccagctggaggatagattggcgagggactaactagaaacttgaagactgccttagtagggcctttgataaacatgttttgactttgtgtgttaaaacagcctgttaggagctgacgaaggaatgatatgctgcccttggctcagggagttcagcctagtggcagggaaggaaagcatgcagtgctgcttggaatgtgctgcttgtgaggtttgtacaaggtatttgtcattccaaaaagggaggtaatcacctctgctgcagttgtgatagggtcggtgggagatgcttttgaggattaggaagagtagaccaggagctggagtggatgggataggacatttttggcaggggacctagaagttagatgaaggtctacacgaggtc

SEQ ID NO: 390604 - DNA, 759 bp, Homo sapiens
gtggcaaccagcttgcgtccgtttccatgtgtgggagatttgttctttcgctctttgtggtaaatcttgctactgctcactctttgagtccacactgcttttatgagctgtaacactcaccgggaaggtctgcagcttcaatcctgaagccagcgaggccaccagcccactgggaggaacgaacaactccagacgcaccgccttaagagctgtaacactcaccgcgaaggtctgcagcttcactcctgagccagcgagaccacgaacccaccagaagaaagaaactccgaacacatccgaacaccagaaggaacaaactccagacgcgccaactgtaacactcaccgcgaggatccgtggcttcattcttgaagtcagtgagaccaagaacccaccaattccggacacactgttatggtcttcagaaggagagtaaaaagaatgctgggtagaagaaatacctgaagaaataatggcccaacctcaaatttggtgaaagacataaacttacagattcaagaaactgagtgttccccaaacagaataaactttaaagaatccacactcaaacacatcataatcaaacttctgaaaactaacaacaaagaaaaacttaaaatcagcaagagagaaaccacacattattcaactgatgaaagtgactcagtgacagcagatttataatcagaaacttgaaggacagaaggaagaggcaaaacattttgaaagccctaaaaggaaagaactgtcaacccagaa

SEQ ID NO: 390605 - DNA, 376 bp, Homo sapiens
atcagtaagtttccacggttccacacccatacaaataaacaagggagaaaggaaagctcttccttacagaagaatgccaacgaatgaatatagaaggaaagatgagattacaaaagttaccatttagtaaccaccaataaccaattcagtcaagaattatcagcggatgctgagactagtgggaaaagtttgagaacaagatagtctaaaagtgtctctcagccacatgtttactagttacaaagagtaaaatagtgtatttacagtagaaaaacctggcacacagcacttaagcaaacgatcaaagataatgttgacagaaatcagactaagcagcagcattgtgcaagataggttgcacggagaacttagccgc

SEQ ID NO: 390606 - DNA, 542 bp, Homo sapiens
  misc_feature (56)..(56): n is a, c, g, or t
  misc_feature (115)..(115): n is a, c, g, or t
tgtttgcagctgctgagtgcctcctagcactgaggaaagcagaaccacgctttgcnacaatgaactctccttgctggaagagaccgcccacctctaacagaattttgtagctggnggaaacttcagacacaagtcctgttacagaagaggaaactggcacagagaggaaatggtgcttgcataaggtctctggacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttacggaggaacagtacccagactatgacacacgacaagagctggcggagatgctcaatctcagggagtaccaagtgcaggtgtggttcaa

SEQ ID NO: 390607 - DNA, 428 bp, Homo sapiens
caggcgtgagccactgtgctcacagttagattttattaacctaaaatgacaggatttgccttggatcagccatttctcaaagcatatgcagttctcacttacctgtgaagacagtagtagagctgtagtggaacacctccaggaaagactaagcaagttccttagtccatgctattttcttgacccctccacacaccttccccacaccaattcagtcagagacatccattgccataggaaaagaaatacacagcagagcatggagaacacgattcgatattacagtatcccagtttcaaatgtaggcttctgaaacccacagaggagaaaaattctttttttttaaatttaagttctgggatacatgttcagaatgtgcaggtttgttacataggtgcacatgtgccatggtggtttgctgcacttac

SEQ ID NO: 390608 - DNA, 251 bp, Homo sapiens
gcgtgcctgagaagaccactcctgatggagtgctgggggaagttcaaggcttggaggccaatgagggggctgatggcacccatccagtggagaggctgtatttggaggccctcctgagtgggagcaaggctatgtggatgatgagatgaggtaagtgagatggaagtggctgtacgaacagccattgaggctgaggcaggaggattgcctaagtccatatcccaggtgtcaagaccttgtctctatcaaaa

SEQ ID NO: 390609 - DNA, 723 bp, Homo sapiens
tgaatcaatatatgataaatcattgcaaaatgccccattcaataaatgttaagtaatattgttttcatcatgattttatataatttgatcctaattacaaccttatgaggtagatctttttatccttattttataaataaagagacttagaacttgttcaaagtagcttgtcccagattaccaagctagcaagaggtggacttgggattcaaatccagaaccctctgtctctctctctctctctctctctctctctctcagacaggttctcattctgtcgccactcttcttcctggatcctacatcaccctgcttcttgatttatgcctttgttttgacagagcatatccttactagctttctgggtaaagggtgcacaactctatcacttcttagctctctcttatgctgtttgtcttcaggtatctaaaataacatgttcgtcctgcccctccttcatccctccctttttcagctgagattctgtgagaaaatgtagtcctaatgccctaaggcatctcttgtatataatgaattagctatgctcctgtgcgtctagaataggattctaggtatgtacttaccttgggagaatggaaaaaatactcacttaaatccttttctgtattttgtagatcaaatacggaaccctggttgaaaaaggctgtgatgctagctgttggctttctgtagtagatgaggatataatgcctaaaccaccat

SEQ ID NO: 390610 - DNA, 257 bp, Homo sapiens
agaacacagattccacctgtgttcctggctggcccgggtgtggttggaatggaggggggtcatgggcaggaaaggggaaatgccccatgccccgaagccctccagtccccaggagccctctccctgatgggggcactatggacatcctgatgagagcaggtggctgtcgggctagtcggggactgtcgggctagtcggggactgtcgggctagtcggggactgtcgggctagtcggggactgtcgggctagtcgggg

SEQ ID NO: 390611 - DNA, 387 bp, Homo sapiens
gacttattcttcgttctgccatgtagtttagtctatatcatgcaattgttttgaggtacagtgtcattttagatgggttggtcttgcttggttaaataggctctaattgacttaaggccagataagtttctttgtgtatcctctcctttgatctataacgccatgcagtataaatagcaagattatgtattttacattggtactattaataaattgtaccaataagcataacaagaaattgatgccttccttaagtacctcacaaggttgtggtaaggatcagaaatgttctgtgctaaataaattgtaattcgtaacctattataaatgttgacagatagtaattacggttgtgttaacaccaagatcttcacatgatgaccctag

SEQ ID NO: 390612 - DNA, 676 bp, Homo sapiens
caggcagatcacctgaggtcaggagtttgagacaagcctggccaacatggtgaaaccccgtcgctactgaaaatacaaaattagccaggcatagtggctcatgcctgtgatcccagcttcttgggaggctgaggcaggagaattgcttgaacctggaaggtagaggctgcagtgagctgagatcgtgccattgcactccagcctgggagataagagcaaaactctgtctcaaaataaaaataaaatgtgatttctcaaattgatctttatatgctatctagatttttagtttctgcaagcttagtgttgttttacaaagtcttctttattcttttttggtgataaaaggcagatgtagtcaattgtggctcttttttcctaaaatactgtgcatataaaatgactataaaaattatgcttattatagaaattttgaaaagtccaataaagctttaagaaaataaaatccttcattcgtaccacctggggaataaatactgtaaaccttgagatgttttgtctttcctctgtgcttatataaacacataaatattgtatgcacagtaagaaagtatgccataaataatttttcccctcttttctccttaatattgtggcatgcttttttatgtcgttacaagttcctcataaattccatctaagatagctatattgt

SEQ ID NO: 390613 - DNA, 434 bp, Homo sapiens
ggagagtagtgacggtgggactggaagccagctcacagctcagtgccactgcatgcaatcatctcctaaacatgtgtctgcacacagatttattcctcctggacttttcccttgaactctgaactggtttagccaatggcccacttgacatcttcacttacatgtctcatagtgtctcatccataacacacccaaagtggactgccgattccacctctgctcccatccccaaccagcatgttcttctgtagtcttcaccatctcagtaaacaactcagcaactaaacaactcatccttctgtactcaggctcaaaaccaaaagtcattcctgacactgctctctcataccctaccagcattctatcagaaaatccagctggctgtattttccaaatgtatcccaaatccaaaccctgctcccctacctcttctg

SEQ ID NO: 390614 - DNA, 289 bp, Homo sapiens
ttttgttgaattatctatccgtgttctcttgtaccttgttgaattttcttataatcattattttgaacttttgttctggcatttcatatatttccttatgattggggtctattattaaagaattattgtgtttctttggaggtgttacgttttcttgcattttcatgtttgatgtttccctatgttgatttctagtcatctagtgaaactcacatcttccaatattttggagtaggttttatagggaaagacttatctgcttggactcaagcacattacatttattgtg

SEQ ID NO: 390615 - DNA, 812 bp, Homo sapiens
gaaagcttcttggtttaagaaactcaaattcattactccagagtaaaaatgtgttttttcattttccccctcaatttgctgaagctgggagccactatcatgtagaggaaaaagtcaagatacctagaggctgcttctggctaggccactaaatagccaggtgatctgggcttagtggtcactttgcactttagaatcatctggagacttaaaaaatatgctgggaattttaaatatgctgatgacaggccccacctaagcccattaagtctgaatctttgggagttcgagcctatgtgttggtgtactttgaaatgctcctgagatggttttaatatgtaaccaatttgagaactactgttcaagatatttacagaggatggacagtctgtgattaaagggtccggctgcagggccagaactcctgctttcaaatccccactcctcaacttcccctagctatgtaaccttgggtaagttacctagagtctctgggcttcagtttcctcatgtgtaaaattagaataatcataatatattagttaatacagatagaacctttaaagcatcttctgacactcaagtattttttgacagtagtacaactaaatataaatatgctctcttcatagttctgtgttgtctctatgctttgtaacatacagccatttacatacttgaagctgtaccttgatattctttttactatactttttaagctttccttttgttttctagccttttaattatatcaatatttccccttttaactgcccaaaattctttattttccttttagttggaaaacccca

SEQ ID NO: 390616 - DNA, 250 bp, Homo sapiens
ctgtagtgctcagtagcactcaccctgggttcatactttggaggatgatactgcatttttggccccgtagcttgctttcccacttgtctgtgagtgcagagcaggagtctgacacttcccactgtgctgcttgctttgcagacactaaattgaagcttcttgctaaagcaaaagccagtaggcgtgccctctaggctattttgctttgcagggactctgagacactcagtttctcccaaatcttttccca

SEQ ID NO: 390617 - DNA, 708 bp, Homo sapiens
gccgggcgcggtggttcacgcctgtaatcccaacactttgggaggccgaggcgggtggatcacctgagctcgggagtttgagaccagcccgaccaacatggaagaaaccccatctctactaaaaatacaaaattagccgggcgtggtgacacacacctgtaatcccagctacctgtaatcccagctgaggcaggagaatcgctggaacctgggaggcggaggttgctgtgagccaagatcgcgccattgcactccagcctgggcaataagagcaaaactctgtctcaaaaagaacaaataaataaataataaatacatacataaaacaaaaaagaaagtgagcactttcatccatatttagatgagggttggtaaactttttctgtaaagagccgaagagtagtgtaaatctgctcaccctccagggtcccatatggttttgcaactcttcagctccgcccctgtagtgcaaaagtagccacagataatctgtaaatgatgtatagacacggctgtgttcctacaaagcataattcatgggcactgacaggtgaatttcatatgatcttcacaatcccaaaaacattcttttggctaggcgtggtggctcatgcttgtaatcccagacctttgggaggacaaggcaggaggattgcttgaggtcaggagtttgagaccagcctgggaaacaaagggagaccatccccc

SEQ ID NO: 390618 - DNA, 248 bp, Homo sapiens
ccactgcaggacagccagggcgggagtctccacctcttccagactcctgtggagcccatccaaaccgggcgggagggaccgaccccagagggtgcaggcgcgggttccctgaggtcccgggtctcttcacgctccccggactcccaggcaattgtattcattcacctgtgttgagctgcgtattgagcctttccctgccatatctcattcaaaccttatcataattgtacaaagggggttctcacatg

SEQ ID NO: 390619 - DNA, 708 bp, Homo sapiens
cagaggaacaaaagaaatcatttcagatagtgacaagagctataaagacaataaaggaggtgaggtaaaagagcagaatgggaaagggttattttgcatttgagaatcagggaaggttcctctgaggagataaggtttgtactgagacctgcatgacaagaaagagccagctttgaaaaaagtaggatattgcaggtagaaggaacagcaagtacaaagaccctgaggtagggctgtgcttgatgtgttccaggagcagtaagaaggataccatggccagagcatggtgagcaaaggacaatttgatggaagaagagatcagaaaggaaggcaggggctagatcatggaggaccttcttggccacagtgtggcagcccgggagtatgtgctgagattgctcttcaagacagaacctgcctcaaggtgtacagtcaatggagagcccacagcagagctcttgtaggattggccagtgttccaactgaggccacgctcttcctgggcagctccaacaaatgattgaacctggtgggaagaatagggttcaccattttggctcaatgcataactcctctaataagaagcctttgctctggacttctggttgacctggactagactttctcagtgcagtaccagactcagaggcttttcctcctccatgttccttcctgcctccctccttccacaggtaggacttgtattca

SEQ ID NO: 390620 - DNA, 327 bp, Homo sapiens
gcgactgcaagatagcgggtctccatagagtgtcctggcaaacgaacgggcatgtatgtaaagaacgtttatctcacaggatgatgcgttcacaaagacatcctccttcctgctttacttttcatcatccacacagccaggtcttttgagggctatttctatgaatctgctaaggtcacctgctcttaacaacacagtttagactaattcttgggcttttgactctttctgacaacactacagaaagctgtaacagaaacaagactctcaccaccaccctcaaacacatgattgcaaagtatgggcacattgctgctagaaaactgc

SEQ ID NO: 390621 - DNA, 484 bp, Homo sapiens
tttttgtttaaaaatagttttgttttcttgttttactgcactgtgaacacagaatgtggcctataacacatctgcttccaaaactttttaaaaagcttttagtgtggcctagaacatgtccattttttgtaattgtttcacgaacatttaagatgaagatatcttctctgtctgtagaactgaaaactttatgtgcctgttagttaactcagtatcgtcaattatattgttcagattcatgtgttatctaattttggcctattatattcattaaaaaccaataaggttatgtgaaactttgttagtacaattgtttttgctaataaatttttataatctttgctttatgtactcaacagctgtgtaattcgaggcatataagtgcagcattgttatgtccttgttaattaaataatatatgtaaaacaccatatgacaatggctggcagatagtaggcactcaataaatgttaattaaaacctg

SEQ ID NO: 390622 - DNA, 700 bp, Homo sapiens
gaactgacttctagttcataaatcttgtgataatatgattaaaatttggacttgtaatggaaggtttcatttgtaacttcagtaggtactgatgcttttaccccctcttttctctatgttcttgaggggttaagaaaacaaaggataattatccaggagcacggccaccttgacttcttcacctaggttatctgtctagactctggtggactctccttaacttaaatttaaaaatttgttgaatagatataacattcacatgctttagaattcttaaaaataaaaggatacattgttaaaagtttccctttcacccatctctacctatctagttcccctcctgggcagcagcaagtgttattttgtgtgtgtgtgtgtgtgtgtgtgtgtgttctttctttaccatttggagcatggtacttctttttctccctgaaagatagagaagtgaagaaagggaactattgctacctcttccactattgctacctcttccactattgatacaaaaagggatattcaggaatttatacatttgattgtaaacgtctcttcttttttttattcccccctccaccgagttggagtctcgctctgtcacccaggctggagtgcaatgggcgatctcagctcactgcaacttctgcctcccgggttcaagcgattctcctgcctcagcctcctgagtagctgggattat

SEQ ID NO: 390623 - DNA, 797 bp, Homo sapiens
attttaagaagtacttttgaatccttcctccaggccaccatgctagacatggaagatacaaagatctattgatgcctttgaatagcctagagtctcttgttcgtatgaacaagattaagatccaataaattaatcacaaagtgcagatgtgcaccctgagcctaaatctgccccccaggtattgggaaaggcctcacagcaaaggtggagactgagccgagcagctgatggtgagtgggagtttatcagatgacagacaggtgaattgcatttcagaaggagggaatagtatgttgcaaaggtaccaaagagggaaagagtatgacagtggcttgaggagagtaagtggcaccagggtcaagggagtgtgttgcatgctctagtcatgcaagtgttttcctggaaaaagaacaaatgcactgtggtaaaattcaagtgcattcctatacttaaaattcaacagatctaaagatagtaattcagagcaaaaggaaattaaaatatttgagcagtttctttgtgacacctgaaaacaagtgccaggggatttatgagttattatctctagaataggtcgcttcatgggcctgtagcctgccatcactcagggacccatgctgagaagcctctgctcttgggcaaatgctctgcccttgctgtcttaaaattctttagtacattttgaacaatgagccttggcttttcatattccatttgtccccagaaattatgcagctgagcctgagaacagaacattttcagataacttgaaatagctcagtattgtatttaaagtg

SEQ ID NO: 390624 - DNA, 404 bp, Homo sapiens
aaaaagaatccaatgagacatgcaactgatatttgaggttagatgcaggcccattttggtttgcagggccctcttccacagggacgctgtcacaaggctctagcttaaacatcttccagccatttccccaagtttcagcttctgtaacatctctgatggatgcattttgactggagcaggaggctcagcagcataatggcactaacatttctctgccgccttttgagttatagctcggtgggcttgccttttcctatttcatggatttgctttctccgtttgttcttacttgattaggaaattgctgtacacagaacttctccctgtccataaatatcacccaagttacacagcatggggagagagctgctattgtttggttcactgactttgggactttttgc

SEQ ID NO: 390625 - DNA, 599 bp, Homo sapiens
agtcacaaggcattttttaatgaaatataatagaaaatatcagtgtatcactcccactaaggataaaaattaaatcataacatttttatttcagttaataaatctacacacatatttactaggtcacaatgtaaattgtatttcttactggaagtcacagccaaaaaattcttaaagccactggattagaggcagagagactgaaagaagagaccagggaagaggctgctacagaaatgcagtctgggctgctaaggatgatgtgtggagatgccaaagagagcctcaagcagtagaagctggggctaggcatggtagcagctcacacctgtaatctgaacactttgggaggccaaagttggtggatcagttgagcccaggagttcgagaccagcctgggcaacatggtgaaaacctgtctctacaaaaaatatttaaaaattagccaggcatgatagcgtgtgcctgtagtcccatatattattacttggggggctaaggtgggaggattgctttagtacaggaagcggaggctgcagtgagccaagatcatgccactgcactccagcctgggcaactgagtaagaccttgcctcaaa

SEQ ID NO: 390626 - DNA, 321 bp, Homo sapiens
catctgtgttatccataaaaattcatgttatccttctttaacagtagagtagtaagagatacattttcatcaaggtatgatatgaatgcctgtgtctgagggatacccacctgctcacatacatgcgcacacagtgacatcaggcaacttggtggttcaggtgactcagcacctgaacgaagatgagagcccgtgcccagaagaggccaggtgcccagctgtaacgcctggcacatggaggccctggcaaatacttactgggtgaaggaatgtaccaaagtcactgcaggatagaggtcagggatgccagacttgaaaaca

SEQ ID NO: 390627 - DNA, 132 bp, Homo sapiens
gaaacactatgttgttgagccccaaacgctatttaatggaaatggactccaacaactcatgtgaggcctaagctcaggctttcttgggaagaacttgttaaaaaattttcttcactactaatagaatttttt

SEQ ID NO: 390628 - DNA, 373 bp, Homo sapiens
aaacccagccaaatgagtattgtctcctccaaagtagtcactctgcctcacagagtgacttatttcaaagatgacctgatttcaaagatgccaggacttaagcccaggttgctctctccagcgcccacgcttttcccactgcagtattctgcctttgccttcaagcagtcacctctcggggaaagaactaacacatgtccagcacttaacagtttgccccataccgctacctgcccagctcctttagtgtttacaccaacctagcaaggtaggtgctattatccccattttccagccgaggtatcaggaagtttaaggaagttgcccaaggttgcacagctcagaaggggcacagctgggatgcagacccagg

SEQ ID NO: 390629 - DNA, 499 bp, Homo sapiens
gcacctcttgaatgagttttaggacattcagaagaaaacagtattctatgccttactgtactttatagatctgatatctaagggacttattctgttgtaaagaaaactgccatttatttaaaataaatttaaaaatatttcagaagaaaaaagtgtttataaacattcttggcagagaagtcacaaactggccgggtctccaccactcctcgctacattcaaattactgttcagagcctaaagacactcaagtttgtcagctctggtagagtttcccactggcaataataattatttttcctgcatgagtttcaacactaaaagtgtcttatagccagaggtgttaagataccaaatctttgtgtgtgagcaaatcttgtatgacctggagttcttgtgcagttgtcaccatcagcacccagccagcttcttatattctcactgcttttatgacctactgttatgattaaaaaccaaccaacccaacaacaaccaagcc

SEQ ID NO: 390630 - DNA, 102 bp, Homo sapiens
ggagttcaagaccaacccatgcaacataacaagacaccatcattacaaactatttaaaaaattagccaaagatggtggcgcacacctatagtcccagctact

SEQ ID NO: 390631 - DNA, 311 bp, Homo sapiens
taaataagctcgggacctgagctcaggctgctcccagccctgctggctgctgccacacactttccccaggtcctcctgcagctcagcagcagattttccaggctccaggcaccatgtgtcggtcagatgaggccaggcacgtaatcagctcacttgaagagaccctgtgcagcaccctgtgcataccaccgtgtgcacacacatgcacggagacacagacacatgcacagagctgcacccacaggcacatgcatgcacacacagacacacacacgatgtgacacatgcacacacgatgcaacgtgaaccaa

SEQ ID NO: 390632 - DNA, 657 bp, Homo sapiens
ccactgaacatgctgtggcactgccagtcactcccaagccttgaccctctgcttgcctggcccaggcccagccaggtgccggtgaggtggggggcagggctctagttgctgggctgagtgcaggaggggaataggtagctgggaacaccctggggagatggaggagagtgcaactgtacatgaggcaagcctcaaccaccccctcctcacagccctcctctctccactcctgtgcatgccccattggcctctggacttcacttataaaacacaaattcaaagacacagttaagaattttaagacagccatgcctgcagaacactgaactccaagtgaccagcccttctgagagtaggcccctctgcaactacactggtcacacccataaagctggccctgcaggatggagatgggaggatggatttgagaggcattaaggacatagtcaaaccagagcatggcaatgttcagggaggaagatgttcagagttcattggagatctctggctgtgtgactgcatagagggtaacaccattaagatatatagggaaacggaggaaattattatggggatgggggcaggggcaagctttagggacctgagaacacttccttcgttccaacagagaatcatctgtcttttctctgatttaat

SEQ ID NO: 390633 - DNA, 452 bp, Homo sapiens
ttgaacactgtcctgatttgcctctgtaataagaagaaatataccacatgctactgatcacaatctctgcaccctctacctgtaagggggaggaaggtggagaaagaatagagtagaaaacagagaagaaagtcaacaaagaaggacaatgcacagaacataatgtatatggtcaaccataaactttccacattaacaaagaactatacaactgccaaagccagacataaatcccctattcccaactagtccaaagcattggttagttattattttaatacttccttttacaaatggactatatcacttctcagagtttaatacactttttggcatatgtatctacaagcatagacagagcttaacaaactttttgaaatgtgtacctataaaacagtaaaaaaaatttaattgtaaaaagacttctaagtgttaatttgaaacacaatttg

SEQ ID NO: 390634 - DNA, 868 bp, Homo sapiens
caattttagtatttccagctgacttgctcctctagtagatgataactaagctattcacattatcacccccatttctgtccccattgtgccccgatgttacatcacacactatgattaaattggacgtcagtgcttaaattgttatgaccacgcacacattctctgctgaaccagtagtgctctgcagtgtttatttcatcctcaaggtaatacagtaattgcttgtttgttaatttgactatttggttttttaaaaaacgtaatcaatctggaacattacagaaagtatgtggaatagtataatgaacccctgtcacccggcgttgtcaatggccagtgttgccccatgtatggttccatcactggaccctttcccatccttttgttatttaataatgtaatacttgtttttaaaatctgaatttaacaaaatagaaagccaagttcatttcttaaagtcgaacagtaagaaattttttctaatgattttgataatgtgtttaaattttacttgtggaaataaattattaaaaattcaaatacatgtggataatctgaagtgtgtaataattggtcaaaataatagaacaggccaggtgcagtggctcacgcctgtaatcccagcactttgggaggccaggcgagaggatctcttgaatccaggagtctgagaccagcctggacaacatagtgagaccttttctctacaaaaattaaaaatattagcagggcatggcagtgtgcaactgtagtcccagctactaaggaggctgagacttgagcctgagaggtctgctacagttaggctgtgattgtgccactggtctccagcctggacaatagagtaagactctgtttcaaaaaaaaa

SEQ ID NO: 390635 - DNA, 439 bp, Homo sapiens
catcctgagtgctctttgttgggttgggagtcagggtgccatgggagagcctgccagatggtctataagatgctgtctgaatcttctaaggtttaacaaagtggatttggacctcacccttgaggccagtgtctgggatttgatctttgccctgaggccatctcttttagaatcttttgccagctggaaaggctgggaagaagaaacatttttattctccacccagtacatcctggattggaaatagttcctttaaattctgcttgaaaatggaacagttccttcatctttctcttcccatgtgttaccctaggcagcaaaaagaagccagcttcctcctggaccccttagccagatgcaggagttcccgggggaggcactccatcctccctgtcactgagggtgaccttctttccacttcttcagctggtacacacac

SEQ ID NO: 390636 - DNA, 777 bp, Homo sapiens
gtttctgattaagtaattgcatatacattgacacacacacacaaatgcactcatcccacgctgaactctccattattatctctgttacttaggaatgctgtagcggatactggggtttctctgtaaccttctttccactatccaccgattgtgtaacacatagttgaattggcatgcctagtccctcagcttcaacacttaaaacattcgggattatcctatgctttctgccaccattgattttttcttataacccaggcagaaaacaagtggtgtgtggtgacattggcttaaccacagaaaatggttcagatttggttcaatgcatttgaatttcagaaaattgacttagaacattaaaacagagatttctttcttcctgatgtaatttgtaacttaaagcctgaatcttctaaaatcactcaattatttgagggaagccactgaaggatagagctgacacagaaaggaaagaatatgtagttgatgcaaacataaaataaaataacaaggatcctgattaaagaacaaacgcctgaaaacgctttaggtatcctttgctccttcatttggttttagtaggtttaccatttaatcaaattttgatggcaggagatacaataaattacatatgactattgttttcaatattaagaaatccatgcttaagaacatattatatattcattgtctacataaaaccttttccttgattaatacactttgtctaggtaagggcaggagttgaatattccatttatagttgaatttcacaag

SEQ ID NO: 390637 - DNA, 717 bp, Homo sapiens
cttagtggcagaagccttggactccaggtaacagggacaaggtgagctttctcaaaaacactgatgggttagctcccttcaaactcaaatgcaaaagaccccccggcatcctcccaccctctccctgaaaagatctcttccaaatgccttatgggggatcttacaggcgaacacattgtttagtttaagcctactgcctggatttcaaattcatcatgaaataaatacttggattcaaaagatgaaaacaactgaattacaacagatttctctaaatcttgataatcaccagattcatgtgaaatgtttgttgaaaagagagagcctaggccccaaaccagatgtcccagggaagaagggcttggaaaacatgtagtattaacaagcaccctggtgattcaatcagcagctgggtttcagaaacttggctttgagttctcaacttactttgaagatttgaaaacaatataatttcaaatattggcaacttcagcagcacccaggacttctgaggtgctcagaccaggccagtgggatgcagaggtttgcacctcacataaaaaggagccaatttcacagggcacagtggctcacacttataaccccagcacttcgggaggctgaggtgggtggattgcttgagcccaggagttcgaggccagtctgggaaacatggtgagatgcctgtctctacaaaaattaaaaaaaaaaaaaaaa

SEQ ID NO: 390638 - DNA, 499 bp, Homo sapiens
aaggagcaatgggacagcctttagtgggtgcatgagccttcagttccatgacattctctccctctctcctgactcacagggcaaccaactgcctgcccaggttagctgggactggggggaccacagaaacagactttcagtgtgaaagtcgttacaatcctgggcaaactggggtggttagacaacctccaactgagacttctttgtgctttatggctccaaaagaaagcaaatgtatttttagaatgcaaacataattgagggacattatcagtaactccgctgaggagagcagctttaggcctgtcccctaagtgcagccccaaagagccaggtcacacaatcaacaaaacctctgtgtcccagctctaagctaagactgagggtagccagtctgggttgaactgggaatttcgggaggtggacagagaaaggaagtcatctgtaactgaagccaaatgggccagattccttaaaaacactgagccatgaaatgctg

SEQ ID NO: 390639 - DNA, 185 bp, Homo sapiens
tccctaaacctgtaaccatgagaccttccgctgtaattcatttactgaacacccactaggtgctaaggaccaagccaggtggtggtatttcagaaaatgaggacacatttgaagagcatccacagtctaatgagagccaaaatgaagtatacaaatatggccaaaataaggcaggatgtggtata

SEQ ID NO: 390640 - DNA, 327 bp, Homo sapiens
agtgttcatggacgcttccagagtagagttgggtagttccaatagagaccatttagaccacaaaatctgaaatatttactatctggctctttgcagaaaaagtttgtcaaaccaaatgttttgccatagcgtgacaagagtaacagcttcccagcctgaataacagtatctccactgccctctgacctgacactgccattcagctaattccacgtgagagtgtctgttgcttgcagcactaacacaagctaccaaacttagtattagtcaaggttcttagttgcaagcaatagtgactctggctgatttaaacagaaaagaaattta

SEQ ID NO: 390641 - DNA, 121 bp, Homo sapiens
gaataaagctcgacccccacaaagtcatgaaaattaaaaattaaaatacaggtggggattgtgtctggcacccagcaagcactcagtgagttttagctaactgctgttgactactattttg

SEQ ID NO: 390642 - DNA, 271 bp, Homo sapiens
cacaacaatcctatgaggtagaggactgtgactccaccccaccgtcaggaaactacagcttctctcaaggttggcataaaataattagagatttcctactcttgttttagacttttggatctcgggttctgaatcttggtcttctaggaggcttcacttgttagcagtttttatgcgtagaatttctagctggaaacagtcttcgctaatctgagtttatcccaatatcagtctttgtaatgtaacatccctacaaggttctacaggaatc

SEQ ID NO: 390643 - DNA, 804 bp, Homo sapiens
cctccaggtaaggatttgaggtctctggtgagctgcaggatcggaaagagtttaattggacttacattccactacagctttagagtccagaatttttttaatttcccagacttaaaaatgacatccatggctgggcgtggtggctcacacctgtaatcccagcactttgggaggcggaggtgggtggatcactcgaggttagaagtttgagaccagcccggccaacatggtgaaaccccgtctctacgaaaaatacaaacattagccaggtgcggtgacgggtgcctgtaatcccagctactcggaaggctgaggcaggagaattgcttgaacccgggaggcagaggttgcagtgagccgagatcgtgccattgcactccagcctgggcaacaagagcaaaactccatctcaaaaaaaaaaaatgacatccattacttttgagacacaaataatgtgctttgttgctttatgctttgatatttcatatttcctccataagagaaagggtgcctgttaactgctccagaatggagggtaatctggaaatcatttccaaatggctttggcatgcagtgtttgaacttaagttttaaacaataatcgtgtttgctggtgagctgggtttgttgagtgtgtctagacttttggggccattcagctctgaagacagacctgcatctcctgcctcaccttggcctctctccacaggcctttgccctccccacacactcctgtgccttcccggctcactcatggctccagtaaccccttctgcccttcaggactctcatcccctaggaaac

SEQ ID NO: 390644 - DNA, 442 bp, Homo sapiens
catctgggctgataggaggagaaatttcagttttcagaaagctgctgagattagaatgcaccttagaaggctggatgatgccacagaggaacgaggagagagaaagcatcgtttggggccgagaagggactgagccccagtcacagcagaagcagacgatgttgggatttgcttgcttcccacaacccagagtcccccacctgcccacactctggcttctcctcaggctgaggtagatttgacacccggcaccccacagctctctactacatgggagtcccgggctccccgcactgtgccagttacgcagaggaggtggactctgcccagaggactccctgtccagctgggcagatgcacttttaaaagacaaatacagttttccatgacagccttctaaagacgagctctggagctgtgtgcccaaggccaggagcctgga

SEQ ID NO: 390645 - DNA, 585 bp, Homo sapiens
ctcctccgcccgcccctgccctgcgcgctggctggcctggctgccctccccagccccagggatgatcagctaaacatgatcaatgaggtgccaaacattttgagacatctggggtctgtagaactagtccttataggacagttctatgagataatgcaataccaacaatatttgctcttactggtcatttgaacaacccacctagtagacccagaaaacgaataaaagaattgttgatgaaacttctgaacaggaacaaaaacataaagaaaccaacaacagcaatgctccgaaccccagtaaagaagggagtgaagggccagatgaggacattttacctctaacccttgaaaagaaggaaaacaaaggatacctaaaatctctgtttgaaatcttgattctgatgggaaagcaaaacatacctcttgatggacaggaggctgatgaaatcccagaaggtctctttactccagataacgtgcaagccgtgctggagtgctggataaattctggtcaagaggtcctgagaaagcagtttgagacaacagcagttaacatgttgttttattaaaaacacagcagagg

SEQ ID NO: 390646 - DNA, 476 bp, Homo sapiens
agaactgtaatgtgtacaatgtgtatgtgtccttggctgtcagtcccattgcagtttcaatgtgtgtttctatatgcagtatatactaagctaatgtagttgttttgtcctttgtcttatctgtgctctatctctagtccggagtggtacagtcccattcctgcagtcctagtgaatcagtgattcttgggggttagtgggttttgtgtggtggccttcctctgtaatgtcaccctatgctgcttctactgtctgtgaatcttccgttttaccttttaaaattcctgctgttgctttgctggtgtatattctccctacctctcctctctttccctccctttcccatctccccctctccctcctcttcattccttccccatccccaaaatctctttcattctcagagataaaaagactcttaactagctcaaggttaatggagccatttttcccacaacggaattctgggtatgact

SEQ ID NO: 390647 - DNA, 133 bp, Homo sapiens
aagtcttagtttcctttcctaaccagctctgtgaacttagggtgacttattctctctgcaggctttcctaacctgaaactgagaggtaatagtacttgccctgtttacctcacagtatggttgaaggatcaaa

SEQ ID NO: 390648 - DNA, 314 bp, Homo sapiens
ccagcctgagctctccctgtcacatcatgtaccctgtggtataaacatctgctcatgggacttctcttactaagtcatctacccatagggaccaccttttcctaaatggcacacaggctctctaagggccagcagaaaccacacaggctagcgtgagcacctttcccctaccttcagtcactgctccaggtcatgtgtgtcattctgtctccttgattctcttgaaagttctgtgaaaggcaggggtcatgctttttggactgttcccttcttcccctttaatcctgtcaccgagtgttcactcatgggatagg

SEQ ID NO: 390649 - DNA, 413 bp, Homo sapiens
gaatggtaagtaaaagaaaaggcacaaaatttgctgaagaaccgtaaatatttaactgaacacctacactgggccaagtaataaaacaatgaaaaatttagacaaagttcccaccttaccaaaacttacagtgtagagggcacaatacacaaacaggcaatacagtgtgaaagtgtgacaagtattgttaaagcagatgaaggacacaatacctaaaggataaataggacaggttaaattagggagacagtgaagataaagggaataaccagagataaggcctgaaaaggcaagagtttgagcaaggtcttgtaaaaagattttatcttaactggagaaaaaggccagaagaagattaaacgtgaaatgttatgtgatcaggttagtactttagatggatcaccctgggaagt

SEQ ID NO: 390650 - DNA, 415 bp, Homo sapiens
tttaatgaaagtgatcgaaaggtatgtttttctgtttctttcaaagcgtatgtttttctattctgcaacactcctggaaaacccatgctgtagtcctcatttaggtgcttaccagttgtgtgaccttggactgaaattaatcactgagcgccttagtttcctcatcaggaaagtgcaaacaatgagacctattttgttagattgtctgaaggatgaaaaatagcatttgcacagccccccaatacccagcacatagtagatgttcaataaatgataactcttatgagcctccccctaggcggggatacttccccttgtactcagctaggaaacttttgactccataataacagagtagctccagccttccaggttccctcctgttctaccctacgtgagcagaactcttttcttc

SEQ ID NO: 390651 - DNA, 362 bp, Homo sapiens
ccacatccagtactctcttgcatgttcagatcgctagaatccaacctctggatatcaaaggatcactactggggcttgaagactccaaatctgcagattctgaagcttgcaggtcagtggccttggactttcaaacttccagttccgtgacatccgggctccttaacttccggcttccgggagcttagtcacatacttctggcttccggattgtaggttccccgcaaggagactaaggcctgtgtgggtctttgtttccccagccgtgcaatgactgttagatgcagaaagggggaaaacagccagggaaactgctcacagtggacccccacggtggagagctggagggagagggttcttca

SEQ ID NO: 390652 - DNA, 582 bp, Homo sapiens
tccttacaaagcccaatcctccccatctcatttcagttgggctgaccacacctctggcattaggtgagagcacataattcaggtcttgccataagaggcttgtagggcatagccaccttgactagacaaacacggggatgaagacaaaccaaccagagacaattagattcagttccaggactgcttgcagaatggctcttgaagaggagatctctttccactgaggttttttgagacagtgaggtataaacgccaagattctagtcaataattttccaccaaatagagaaagcatctctgaaatccgaaactaacacagaggaaagaaacttggaattgttcacacacctaactcaaggcatgcttgatgcccaccccccgaaaaacaaacaagcatcaacctttttgaacgtttcagttagccaatatattatttttttcttaagcccattttgagtcattttcctgctgtattcatccagaacagacctgacaaatagattctgaatgcctcagttcaaatgctagctaggttagtttctatctgtgtgattgaattacatgatatggtggattcctcct

SEQ ID NO: 390653 - DNA, 421 bp, Homo sapiens
ctaatgataccagggtgactgtgattggtttctacacacactaattggacagggaaactggagaagaatggtcctgcctaatgacttacggtagaccttttagtgggaaaggaagatccgagggaaggagcagaggggagtgcttcgcagacttgcctcattgcataggttgctgtagaagtggtagtcctggtgtaaaaagactcccccttggcttgatgagtacaggaagacagcaggcattgccttcaaatatcactcattgctgacactggagaaggtcaagaatagggcatgagctgagtgatatttggaagcatcacatgttctcttcctggacttagcagacaagcagaagcctgctttcaaccaggactacagctttctccaccatacgcacatctacctggcactgtttgga

SEQ ID NO: 390654 - DNA, 408 bp, Homo sapiens
tttgggaggtgattggatcatgagggctctgctctcacaaatggattaatccattcatggattaatgagttatctcgggaggaggtttgttatcacaagagggagtctgttttaaaagtcagtctggctgtctctcgtgagcctccttgcaatgtgatgccctgcaccgcctcaaaactctgcagagtccccaccagcaaaaaggccctcaccagctatgaccccttggccttggacttcctgcctccaaaactggaagaaacaatggtttccttaatagattacccagtctcaggtattcaatcacagcaacagaaaacagacaatttccttctgttttggtgaagcatgggggaataaaaggcaaagaggagaagaaaaaaatgaatgctatctcccaaggaacag

SEQ ID NO: 390655 - DNA, 505 bp, Homo sapiens
cgggtttctaacattgcttgttttcccctggtaggggatttctttgcatatgggaaatcaggccgaagttgccagtaacagccacatccatgatttgtattaaaaataactattcatcattctgggctagagctctgcttaccatggctcacctgggaagatattctgattatgtatctaatcattatgatgccacctttcgagaggtgagcagacaattaacaagtccttcaaattatgttcaaaacccagagtttgagaaaatgttccaacgccttcaagtgtgaagataataaaaacattacctaatgcttaccgttcactgacagtgtgctgggcagacattgttttcagctctggccttgtgttaactcgtgattctcagaggagtgggtattattcccagatggaagatgaagaaatggccacagagaagttaagtaatttgtccaaggtcacattactgttcttggcggggctgattccagagactgcatccctaact

SEQ ID NO: 390656 - DNA, 710 bp, Homo sapiens
agttcaagaccagccagggctaacatgttgaaacccagtctctactaaaaacagaaaaattagctgggcgtgtggtgtgtgcctgtaatccctgctacctggaaggctgaggcacaagaattgcttgaatccaggaggcagaggttactgtgagtgagattgcgccactgcactccagcctgggtgacaaagccacacagcactttgggaggctgagacaggcagattacaaggtcaggagattgggaccatcctggctaacatggtgaaaccccatctctactaaaaacacaaaaaattagccgggcatggtggtgggcgcctgtagtcccagctactcgggaggctaaagcaggagaatggcgtgaacccaggaggcggagcttacagttagccgagatagcaccactgcactccagcctgggtgacagagactacgtctcaaaaaaaaaagttaatttatatgaagttttgttttgccttttttctaggacatcctgacatctataaatggcaatatatattgataatatccgagcataaagagggaagcactgcccctatcacttttctcccccaccactcccccttttttttagtggaattagtatttcatggaacaattcagtcaaaacaccagtttggaaaagtttaaaaaaagtatctgttcagatttttttaattacctaggagaaataaactcttttctt

SEQ ID NO: 390657 - DNA, 420 bp, Homo sapiens
taaagcattgatcctctaagaatttgttttgtgtagctcaaatatttctcatctgcttttaaaaaaaagttgattttacaaaatttgctgggagtggtaggggcggctcatgcctgtaatcttagcacttttggaggccgaggcaggaggattgcttgagcccaggagttcaaaaccagcctgggcgatagtgagaccctgtctcttagaaactacatatatattttacaaatttatttttctttgaggcagagtctcgttctgtcacccaggctggagtccagtagcatgatctcgacttgttgcaacctctgcctctgtggttcgaggtatttcggggtgcctcagccacttaagtagctaggattacaggtgtgtttcacttcacttagcaaatttttgtatttttggtagtttcac

SEQ ID NO: 390658 - DNA, 227 bp, Homo sapiens
ttacctgatagtggtctctcaaggcagatggacctggggtgggcacatccctcttggctctgcatattcctcttcactccacggcaaaggttgtggccagaggaggaccacagtggggcccagggcagatgcctctctcaggtcaaagggcagtaccatgcccatgccacaccccggttatactgaattatttttaattcactaaatacaccatgctctttgccaat

SEQ ID NO: 390659 - DNA, 690 bp, Homo sapiens
tttgtaaatgggtgcttcttcccccctgcttccttgtattttctgatttgtttttgcaagtatgcagaaaagttttttattctaattgttttataatttcacctttttattcttaactacttaatactggaattcagggatatttgtattgtagggcagttttctaaatatgggactttatcttacttgaaatggatctttttcaaaatcaccatgtagcaataaaaatgggtaatataaatatggaaaaagtgaagcaacattatgaatggatataatctagagagaaaggggagtttttttaggaactgaagactgttcaaatctcattgttactcattgagatctgccttgactatgctgtttaaaattgcaaacattcacttctactacttgattgttttgccctgctctcctttttccccataaaccttgttattatctaacatataatttactcccccagccctattatctgttcccactagaattgaagctccttaggttgggattttcacaacagtttcctgggacataccaggtgctctataaatattagttaaatgaataaaatttctagtaaaatcaagtatttaagtgggagtttctggaaaaaaaagacctaattgtctgagagagggattctactagagaatttaaaaattagcccaaacgaggccctttcttccc

SEQ ID NO: 390660 - DNA, 1028 bp, Homo sapiens
aggcagatcgcttgagcccaggagttcgagaccagcctgggcaacatggtgaaattctgtctctacaaaaaaatacaaaaattagtcaggcgtggtggcatgcacctgtggtcccaactactccggaggctgaggtgggaggattgtttgagcccaggagcctgaggctgcagtgagccatgattgtgccacttgcactcaagcctgggtgacagagtgagactgtctcaagaaaacaaaaacaacaaaaacccaaacaattatgtttgccactttgcttttctgtaaaagttttggtatctgctttgcctttgctttcatggtgctcctttggataagaacttccatttctactaatagtgattgctaactacagactacaaatgatacagtgggaatagcttacagggcctggaagaagcagcaggtgatggggagcctacagcaatgagccttggtctgacccccacccccacctcatcccaaccacccaccacagtcattctctggtggccagaaagttgaatttgtaaacctgacatccagatgtagtttggagaagcagatttaaggagccctagtgtgctaggtgttatgggggatcacagagagagagaggtggaactggttatgcccttgaggaatttccattctagatgtgaagacaagattttcatgcatatacacataagtgccaagagtaggaggtagttacatttttcttatcaccagtgtaatacaagattattaaaaataaatgcaaggccaggcacagtggctcacacctgtaatccagcacttgggagcctgaggcaggcggatcacgaggtcaggagttcgagacaagcctggccaacatggtcaaaccctgtctctactaaaaataaaaaaatcagctgggcatggtggcaggtgcctgtaatctcagctacttggtaggctgtggcaggagaatcatttgaacccaggagacagaggttgcattgagctgagatcatgccattgtactccagcctgggtgacagggc

SEQ ID NO: 390661 - DNA, 314 bp, Homo sapiens
aagttgattcagttttaaatggcatgattttctcaagccttggaaaaataattgatggattttcttcttttttcatagctcaagtatacaaactgcaaagtcatgtctaactgtttaattttacaagactggaaaatattgaatttaaagcttaggctttagtttaggtttattcctggtgttcaacactgtctaaactttcacaggcaaatcggaaatgaaacacaattgaaagtaaaccatgctttttctgcctgaaaggggccttaatatttcattttatgttttcaaatggaatctaatgagaacgtgat

SEQ ID NO: 390662 - DNA, 530 bp, Homo sapiens
tggtacactagatgtaagaaaataacaacaaaattagggcccacatctccctgacttgccttttttagtattaagagttatgtttcaaggaaaaagtcacttcactcttctgatctccattttattattaatagaagaaaatcgctgcatagagtgacctgaaagcctccttctagctttaacaatctaacggtataaccagctcttttagtcatgaagtgtgtacgaatgagattctaccacttttctaaatgatatcactctgccaagcaactgggtcttcatacactttgtaatcaataaatgttttatgttgcccctttagtatctatagctattccccaaagttatgttacatgttccccttaaagaggatgaatcattctggcccttcaggatctgatattcttcttctctgtcaaatacaattatttgtaattagaagcctggctccaaaaacagaaacttagatgaagaaaaaataaatgttaccagcatagatttctacatccataagtccctgtacaaaa

SEQ ID NO: 390663 - DNA, 560 bp, Homo sapiens
ttttttttttttttttgcagagatgaggtcttactatgttaaccagcctggagtcttgcactcctggcctcaagcaatccttctgtttcggctttccaaagtgctgggattacaggtgtgagttgctgcacccagcctctggtacctctttttataagccaacccaagcgacagggtttttccctgttgtccaggctggagtgcaatggtgtgatcctagctcaatgtggcctcacactgctgtgctcaagtgatcctctagctccaccttccctagtagctaggaggtccttcatgtccataatgtggaagttacccattccagtatatagattatgtgctgagaatttggaggctgcttccatcaagaatatcatattatgccaggcgcagtggctcacgcctgtaatctcagccctttgggaggccaaggctggtggatcacctgaggtcaagagttcaagaccagcctggccaacgtggtgaaacccagtctctattaaaaatacaaaaactagccaggcatggtggcacacgcctgtaatcccagctacttggga

SEQ ID NO: 390664 - DNA, 307 bp, Homo sapiens
ctcagctgggtggttcttctgctctgcatggtgaagctgaagtcacatctgcagcttcattcaactgggagcttagcttgggctgtgccactgaagatggcctgtcatcctctagggcctctctccacttggcatccattattcagtaatgtatgctgaagctcgacatcatggaagctggttttcaggaaggagcttttcaagaggacaagtggatatcaagtctctgcttgcatcatgctttctttttttgagacattgtgttgctctatggcccaggctggagtgtagtggtgctactatctct

SEQ ID NO: 390665 - DNA, 639 bp, Homo sapiens
gaccatattgcatttgttatttatgtttttgcttatctcagcacctttatggaaatgtgtttcttgttgtctgtcttcaccagggagaagccaaggctgagtgactcatcagaggatcacggttccttccgagttttctagagcctgcagtatgggcaagagttgagggtcagtggggaacagacaatgtttttgtccccgagaaacttatatgtggatggaggagctttctgtctaagaactccatgcccctcaggtttagcacctgaccacttaaccctttgtttctttcccatggttaagggaaacaatgagttaatttcctctctgcaaatgactggtctttgtggaggacagaggaaagaggaatggagccagtgattgaagtttgttcattcattgatgtgtgtaagttacagtcagctgttggctagatagcctcagtgaaacccacttcatgtgcctagagagtcccctcctgttgaaggtacacagggcttgtgcaccactttaagagtgtggtagaagtgatgatactgtgattccagctaagcaatttgagccagcacccagctgtctgagccattctagctgggaccccagatggttccccccaacagatagctcagggagctgaga

SEQ ID NO: 390666 - DNA, 1585 bp, Homo sapiens
tgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgactgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccactcagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttaaaaaaaaa

SEQ ID NO: 390667 - DNA, 3804 bp, Homo sapiens
  misc_feature (2360)..(2360): n is a, c, g, or t
tgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgactgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccactcagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtttcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctganagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttaaaaaaaaa

SEQ ID NO: 390668 - DNA, 4943 bp, Homo sapiens
  misc_feature (2360)..(2360): n is a, c, g, or t
tgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgactgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccactcagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtttcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctganagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttaaaaaaaaa

SEQ ID NO: 390669 - DNA, 5018 bp, Homo sapiens
  misc_feature (2360)..(2360): n is a, c, g, or t
tgagcgacaacgagatccagcggttgcctcccgaggtggccaacttcatgcagctggtggagctggacgtgtcccggaacgatatccctgagatcccggagagcatcaagttctgcaaggctctggagatcgcggacttcagcgggaaccccctctccaggctccctgatggcttcactcagctgcgcagcctggctcacctggccctgaatgatgtgtctctgcaggcactgcccggggacgtgggcaacctcgccaacctggtgaccctggagctccgggagaacctgctcaagtccctgccagcgtccctgtcatttctggtcaagctggaacagctggatctgggaggcaacgatctggaagtgctgccagacactctgggggctctgcccaatcttcgggagctgtggcttgaccggaaccagctgtcagcactgcccccggagctcgggaacctgcggcgcctggtgtgcctggacgtgtcggaaaaccggctggaggagctgcctgctgagctcggcgggctggtgctgctcactgacctgctgctgtcccagaacctgctgcggaggctgcccgacggcatcggtcagctgaagcagctatccatcctaaaggtagaccagaatcggctgtgcgaggtgactgaggccatcggggactgtgagaacctctctgagctgatcctcacggagaacctgctgatggccctgccccgctccctgggaaagctgactaagctgaccaacctcaacgtggaccggaaccacctcgaggcgctgccgcccgagatcgggggctgtgtggcactcagcgtcctctccttgagggacaaccgcctggccgtcctgccaccagagctggcccacacgacagagctgcacgtgctggacgtggcggggaaccgcctgcagagtctgccgttcgcgctcacccacctcaatctcaaggccctgtggctggcagagaaccaggcgcagcccatgctccggttccagacggaggatgatgcccggaccggcgagaaggtgctcacctgctacttgctgccccagcagcccccactcagcctcgaggatgctgggcagcaggggagcctctcggagacctggagcgatgccccgccgagccgcgtcagcgtcatccagttcctggaggcccccataggtgatgaggacgctgaggaagctgcagctgagaagcggggcctacagcgccgggccacacctcaccccagcgagctcaaggtgatgaagaggagcatcgaggggcggcggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaagccacgactgctggcggggaggaagacgccgaagaggactaccaggagcccacggtgcatttcgcagaggacgcactgctgcccggggatgacagggagatcgaggaggggcagcctgaggccccctggaccctgccaggcgggaggcagcggctcatccgcaaggacacacctcactacaaaaagcacttcaagatctccaagctgccccagcccgaggccgttgtggctctgctgcagggcatgcagcctgatggggagggccctgtggctcccgggggctggcacaatggcccccacgcaccctgggctcctcgggcccagaaggaggaggaggaggaggaagagggtagtcctcaggaggaggaggaagaggaggaggaggaaaacagggctgaagaggaagaggccagcactgaggaggaggacaaggagggggccgtggtttctgcgccctctgtcaagggagtttcgtttgaccaggccaataacctgctgatagagcctgctcgcattgaggaggaagagctgaccctcaccatcctgcggcagactgggggcctgggcatcagcattgcgggcggcaagggctccacaccctataagggggacgacgagggcatattcatctctcgggtgtccgaggaaggccctgcggcccgggctggagtccgtgtgggtgacaagctcctggaggtgaatggtgtggctctgcagggcgccgagcaccacgaggccgtggaggcgctccggggggccggcactgccgtgcagatgcgagtgtggcgggagcgcatggtggagcctgagaacgcggtcaccatcacgccgctgcggcccgaggatgattacagcccccgagagcggcggggaggggggctgcgcctgcccctgctcccgcctganagccccgggcccctccgtcagcgccacgtggcctgcctggcacgcagcgagagggggctgggcttcagcattgctggtgggaaaggctccacaccctacagggctggtgatgcgggcatcttcgtctcccgcattgccgagggcggtgctgctcaccgcgcgggcacactgcaggttggcgaccgcgtcctctctattaatggagtggacgtgactgaggccaggcatgaccacgccgtctccctgctgaccgctgcctcccccaccatcgccctgctgttggagcgggaggctgggggccctcttcctcccagccctctgccacattcctcaccccccaccgctgctgttgccaccaccagcataaccactgccacccccggggtgcctgggttgccgagcctggcccccagcctgctggctgccgcgttggaagggccatacccagtggaggagatccgtctgccaagagctgggggccctctggggcttagtattgtcggaggctccgaccattccagccacccgtttggtgtccaggagcctggtgtgttcatctccaaggtgctcccgcggggcctggccgctcgcagcggcctgcgggttggggaccgcatcctggcagtgaacgggcaagacgtgcgggatgccacgcaccaagaagcagtcagtgccctgctccggccctgcctggagctgtcgctgctggtgcggagggacccggcacccccgggcctacgggaactgtgcatccagaaggcacctggggagaggctgggcatcagcatccgcgggggtgccaggggccacgctggcaacccccgcgaccccacagacgagggcatcttcatctccaaggtgagccccacgggggcagccgggcgcgacggtcggctgcgtgtgggtttgcggctgttggaggtgaaccagcagagcctgctgggcctgacgcacggcgaggcggtgcagctgctccgcagtgtgggcgacaccctcaccgtgctggtctgtgacggcttcgaggccagcaccgacgcagccctggaggtgtccccaggtgtcattgccaacccctttgcggcaggcatcggccaccggaacagcctggagagcatctcttccatcgaccgggagctgagccctgagggcccaggcaaggagaaggagctgcctggacagaccctgcactgggggcccgaggccacagaagccgcaggtcggggtctgcagcccctgaagctggactaccgcgccctggccgccgtgcccagcgctggcagcgtgcagagggtaccgtctggagcagctggagggaagatggctgaatctccctgctcccctagtggccagcagccgccctccccgccttctccggatgagctgcccgccaatgtgaagcaggcctacagggccttcgcggccgtgcccacttctcacccgcctgaggatgcccctgcccagccccccacgcctgggcctgcagcctccccggagcagctgtccttccgggagcggcagaagtactttgagctggaggtgcgcgtgccccaggccgagggcccccctaagcgcgtgtccctggtgggtgctgacgacctgcggaagatgcaggaggaggaagccagaaaactacagcagaagagagcgcagatgctgcgggaggcggcagaggctggggccgaagcgaggctcgccctggacggggagacgctgggcgaggaggaacaggaggatgagcagccaccctgggccagcccgagccccacctcaaggcagagcccggcgtcccccccgcccctgggaggtggcgccccggtgcggacggccaaagctgaacggcgccaccaggagcggctgcgcgtgcagagtccggagccaccggcacccgagcgtgccctgtcccctgccgagctccgggccctggaggccgagaagcgtgcgctgtggagggcagccaggatgaagtcattggaacaggacgctctccgagcacagatggtcctcagcaggtcccaggaaggccggggcacgcgggggcccctggagcgactggccgaggccccttcccctgcgcccaccccgtcgcccacccctgtggaagacctcggcccccagaccagcacctccccgggacgcctgcccttgtctggaaagaagtttgactacagggcctttgcggccctgccttcttccagacctgtctatgacatccagtcaccggactttgctgaggagttgaggtccctggaaccatctcccagccctggcccgcaggaggaggatggagaagtggctctggtgcttctgggcaggccctcacccggcgctgtgggccctgaagatgtggcactgtgcagcagccgccgccccgtaaggcctgggcgccgtggcctgggccctgtgccctcctagaggagcaggcacctcccccagacttggggtgggggccctgccagctccagcaccacccttgccccaagtcttttaacctgggtgttagcattttaaagagaccccacaggagttctggcctgtgactaactaactgccccaccccagccgagacctcggcgagactgtaactagtgatgtttgtacaaccaaagactctattttgtggtttaaggagaataaagttgactacattttaaaaaaaaa

SEQ ID NO: 390670 - DNA, 351 bp, Homo sapiens
caggaagttacaagggttttaggagctctgtgccagaaactggggataaagaccaaatatatgtttcctattatatcacaatatcacagcaccagtgtgaaaaatagaatgtcatagtggaaaagtcatgaattttggagtcaaacagaggcaggttagaatcctaacatttacgggctgtttgaccttgagctacttatatgaccttctgagccttcttttcctcgtctataaaataaggatggcaattcctgctttgcagagttcctgtgaagaacacagaaaaaggttgtatcgttttctggcacatggtaagggaataaagaaaggattgtcaataaattgtggcta

SEQ ID NO: 390671 - DNA, 271 bp, Homo sapiens
ttcatgcatatcaaagaaaatggggtctttgtcttctgaaaaccactctctgacaggttccatgaaaatacccatggctgtttcaaaaaagaatttcataaattttattttgaggattaagtatagtttttgcattcttgctcttatgacatatttacatgtttcactatgcatctaatgactgagaacttttcttatacattctaattcgcagtgtttctactggaaatgacttttgaaatccatttacctccatcttcattcatttact

SEQ ID NO: 390672 - DNA, 117 bp, Homo sapiens
gctctgaatatgaattaactgacgtgagtaaagtgctttgagcagggcttgatgagtgatgtgtactaggacccttttccctcatcgcttgtcgctgctgctgatggcaatggccac

SEQ ID NO: 390673 - DNA, 397 bp, Homo sapiens
gctcctcctgcctctggctctcagtgggctgctgggctcccccctggctccccgctggcctccctgagcacacccatggccctcttgtggcacaatcaggaaccctctcactccagccaaagcccaactcctgtctcgcttgcttggttactgacttcataaggcagtggggctggcccaccctcagcttcttcccctgggcctcagtgacctctgtcatttaggctggaggagaagggcacaaagggggatgctggagaggagaggagagatgaagccccgtgtgtttcctctaggaggaattgagcttgcataatgtgacctccttgtgcaagcccacagtcaccagacgaattggtggcaaagctaggtctcccaattcccaggcccatgtgtc

SEQ ID NO: 390674 - DNA, 407 bp, Homo sapiens
agactccattccccccaccgcccccccaaaaagaagaagttggggaatgaaacattaatgatcgagtgagtgaactgagtctgggtttctccttctcaatcccttttcagctggccagtccacctgtattatatgctttgtatgcgttaaatcctgctggaaggccagactttctaaatccacagagaatatcagaaaatgttttgaactcaacagtaacaaaaacaacccgcatcaaaatttatggggtaggccttcgtgacaaagactcttagaaaagcacaagttggagaggatttcattaattcagtaaagagtatcacacagaacatctagcacacaccacgcttactgatggattaccaaagcgcccgtcacagcctgaaggagacaaggtgcctactgtc

SEQ ID NO: 390675 - DNA, 386 bp, Homo sapiens
tttctcaataactcgttcttttaccctctttccttctttccccagcccaaattgggacagtttcctatgggtgagaatttggtttatctctgtccaagaattggtctcagcattccgataaaagctaccaaaccgagagacaagcagaaagatcacctccttttctctggagtcgttcttcctatgagtgcagtctgaggtctcatcaattttgggagcagccaaatcatatattactattcctatcaactaaagcccttgaatcttttaatatgacttaaaatttgcccaccctatacagttgggttttctaactcaaatgaagaatcttgattacaaaaaggagaaaagaccaaggtatttaaaaagaacttagtattatggag

SEQ ID NO: 390676 - DNA, 396 bp, Homo sapiens
tttgtgttgaagatatgaatgaatgaagtttccacacctttatgtggagacctgataagtaagcaacaataaggaagggtccccaggttggggagagccccaagttgagaacaataatgaacaatgattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagttgttgcaccacgatatggtt

SEQ ID NO: 390677 - DNA, 333 bp, Homo sapiens
cagcaccacagtagatgctgatgaaaagaaagttatgaatgtcatgtaaaatgacagtagtattagcaaatgtgcttttaattataagaaaattacaatatgtaaaaaaatttcaattttcccatattatctcttaataataactgccatttgttgagcccattgggtatgttacatatattaacacaacaggatggacattatctatcttatatatattatgtgtatatatacggaaaacaggacacaaattgtctgaggccatggacaattagcttgcagtaaagtaggattctaaattaggtttctctagctccaagacccatgccattt

SEQ ID NO: 390678 - DNA, 369 bp, Homo sapiens
gtgtggagccattattcctctcttcacatccaggtcatgtggagagctgccaccttccatataggtagataacctggcctcattgttcataggacaccagagcttccaggaatggggtggccaagggcctgggtcccagcacttcagtggccgttgataacagaggcaagctttcgactgaacccctttaggctccttcattcctgccagctcacccttacctctccagtagtaaagggcttgtgcctttgcctgctctgggtgagagtcccagagcacagtagcccatcaaactgtgttgcagctgtcactattccctggatacagaaagaaacaaaggccaaagttagggtgctaatggtttgggat

SEQ ID NO: 390679 - DNA, 665 bp, Homo sapiens
tgttagtattctgtaaggacatttgtgtttatatatatctgtcatatgtatatatatatcatatatatatcagtcatatatatatctcacacatatatgtaagtgattttatgctatgtatctttttttcttctgatatctttttctggtttcaatgttagtttaatgctagcttcatcaaataagttgggaagtggtcttttactcatattttgaaagaatttgtgtagaattactataaattgttaaggagaatttttgtagaatttgctagtgaatatatttatgttttgaattttcttttgtggaaggtttttactacaaattccacttacttagtagaattaagattattcaagttatctaattttttactgagtaattctggtctcattatgtctttcaagggaatttttttcattttttaatatcattttatagctttatattaaaagttctgaatatgagtggctctctgcctgctccctttcaccaccttaatatcttaagtgaataatgcattctcatcaagagggttaaaactaatcatcagctgatggcagttcactttttgaattacaaaaaactttccccctcaggccatttattttactcataagcaacctaactatattatagattctaaaatattatctccaaagccc

SEQ ID NO: 390680 - DNA, 168 bp, Homo sapiens
agagatcacatgactgtactccagcctgggcaacagactgagaccctgtctcaaacaaaacaaaacaaaacaaaacaaaacaaaacaaaacaaaacaaaacacaccaatggagaactagaagctggcattcacagggtattcttgtgactgtagccattgcactccgg

SEQ ID NO: 390681 - DNA, 369 bp, Homo sapiens
ggtgaggaggtagagggcaagtgaggggcgtgggcaggagaggagcagggtgaaaggcaggttgcagggggctggtggctgatggctgagctgggcagaggggccccaccccgtcccatgccaggctctggactcaggggagaccagtaggacttgaatggcagaaggccatgcatgaaggggactggcagggaggggaacctgccagccgttgggtaaggggctgggctggtgggctggctgggaggactgcggccagtggcaaggcaacaaagacgtgaaaagaaacaacggcatctgaatggaggaatcggcttctgctgacccctgggtgccccagccctgagcatcccagccagagcttcctgg

SEQ ID NO: 390682 - DNA, 239 bp, Homo sapiens
tgccactgcactcaagtctgggcgacagagtgaaactctgtctcaaaaacaaacaaataaagcttgatgctaaagctagaactcttgcttactgtgctgtactccaccgaagggagtctaagacttgacatgtacaaaccacgcctgaaagttagtgaatggggaaaatattgaagaaatatcgactatatcacagaaattgctatttctatactttaaaaccttgcaaatttttgatg

SEQ ID NO: 390683 - DNA, 521 bp, Homo sapiens
actgtggccgaacctagtgtgtaagggggatgtagtgggcagtggttggagaagtcaactgcctgcatgtgcaaacccttctctgtcagcccagaaggccagggctttgtccccatggccaagcagagtcaaggaagggttaagcaggggggtgacattttagacagactgagattgccacatagaccacgagctggaggtgataagtttagaggaagtgaatgtctttgggtgagcagtatggtggcctggactagggtagacatagtggaatatagagaagaagtggaattcaacacagcatggggggaggtgagggagaggaaggcaaccctggctttgttgttggggatataaatcccaggcccacagttgaatttagcaaacagttgctaactggtttgggctcacagagtggggagctgggggtccccacgttgtttcacaggtgaaaaattgaaggccagtagcaagtgagaagccctgacctgccatctaacctgctgacatcagtaaaaacc

SEQ ID NO: 390684 - DNA, 243 bp, Homo sapiens
tggtggctttgcctggacctgggctcctgagaggctgtcaggccctgcagtcccagagggatcagggtgagatccctagtgctgagctaagggccagaatgtaacactgaaacccacctgggacccgcagaccccctcccccgacagacacactcccctcagggtctgtacactcaaaaacacaagcaggagatcctcctgtcaaaataaacacaaaatgatacttccaaagccacaggcgga

SEQ ID NO: 390685 - DNA, 448 bp, Homo sapiens
gggagctgggggatggggtaccaggcccactgtgcagataggggaactgaggctcagagaggagaggaggcttgctgagctgagaatggaggaaggagtccaggggttctcagaaaatggacctaaaaaggcgtatcccggagggcctcgaatgccaagctaaggagttccttctttgccttgtcatgacgctccccaaagccaccatgtgccgctcctgtgctaagcattttgcttggacacgtgcccccgattcttcaactcaacctcgggccaggtggtattggtactggcagaacatttcagaccaggtgaccgagaactgggtacctctgccaaatcactctgctgagaagaggcagaggtaggatctgcaccctggtcccgacctgatgcctaagcctgaaaccctgttccacacggacgggggacccaagaggaagagagt

SEQ ID NO: 390686 - DNA, 470 bp, Homo sapiens
gggccactaatatcactaaggaaacctaaagccgggaactgcttagggcaaacctgcctcccattctattcaaagtcacccctctctgcccactgagatagacgcatatctgatttgcctcctttggaagggctaatcagaaactcaaaagaatgtaaccgtttgtgtatcacttgtctgtgacctggaagtcccttcccccgttccaatcttccgcctttgattcaagttgtctcacctttccagaccgaaccaatgtacttcttacataaattgattggtgtctcatgtctccctaaatggataaaagcaagctatgccccaaccacctcgggcacatgtcgccaggacctcctgaggctgtgtcacgggtgcatcctcaaccttggcaaaataaactttctaaattaactgagacctgtctcacattttctggtttcacagtagttgcacaataacattcaaataca

SEQ ID NO: 390687 - DNA, 123 bp, Homo sapiens
ggtatcttcaggatcaaatataatatcttggagagtgtaggtatgcatgattgattgttggctggctgaacaaatgaattgatattttatttatatttgtaacaacgtgagatagggaaggat

SEQ ID NO: 390688 - DNA, 284 bp, Homo sapiens
agagaaggcaaagccttctaggaagtgaagatccagaggcgtggttaatggaatggccagtagacagttcactatgacataatatgaagtgaaataaagagtatgtaggttggttgggggggttttaagctgatctttgtatatttgcaaattaaccaggcatggtggcatgtgcctgtagtcccatgtactttggaggctgaggcaagaggatcacttgaggccaggagttaaaggctgcagtaagctttgatcaaacctctatgctccaacctgggtgacag

SEQ ID NO: 390689 - DNA, 594 bp, Homo sapiens
tagcctgttaacgcagtattttagtttttagtttttacaaatgctagcaacttaagagatttcataattttcagatgggccatcaactgagaaagaccttgacgaaaagaagaaagaacctgcaattacatcgcagaacagccctgaggcaagagaagaaagtacttcacagtatagacatatatttatattgaaagtcatagttttacttcctgcatcaattcccctgtctaatgttcccctatttacactcctttttttgttttctaatcaaatggaagtagtaaatgtatgtagccatgtattctaatttatttttttttcagatttcttgaacatttgagaggtagaagacattgaataaataagaagttatttatattgtactcaacaagtttaattgaatgggattgctggggtaggcactgatggaattgataatggaggtagtgattagggattcaaatggttgcttcctctatttaccacatttttttttttagatttattttggcccttgatctcattctcctttgcatgctttttttcttccttttgaatttagcaatttgtggctaggcacagtggcccact

SEQ ID NO: 390690 - DNA, 2871 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390691 - DNA, 2808 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcgtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390692 - DNA, 2725 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcgaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390693 - DNA, 2928 bp, Homo sapiens
  misc_feature (2881)..(2881): n is a, c, g, or t
  misc_feature (2894)..(2894): n is a, c, g, or t
  misc_feature (2898)..(2898): n is a, c, g, or t
  misc_feature (2904)..(2904): n is a, c, g, or t
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaaaaaaaaaaanaaaaaaaaaaaanaaanaaaaanaaaaaaaaaaaaaaaaaaaaaaaa

SEQ ID NO: 390694 - DNA, 3031 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttgtgaatcatttaaattgtatcataagttttatgtgttaaaaaaaacaaagggggcgttaattcccgagggcaagtaggctccgtttttcaatgcctagggacgtatagagggggggtaaagtggtggaatgtctggtttgtggactcttggggtatgacccgagtagcggatatagttgacgttgggatgtgttataaaaaaaaaataacatataatagacataat

SEQ ID NO: 390695 - DNA, 1673 bp, Homo sapiens
tccacgatgaggccgaggaggaagggggggcctctggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390696 - DNA, 1682 bp, Homo sapiens
ccacctactcacacctaccgcaccgaagaggaagcctcctgcagggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390697 - DNA, 1677 bp, Homo sapiens
gcacacccaccacctcccccacgggcaacgaggggaaaaacttaaaaaaaccggacgctgtttaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390698 - DNA, 1605 bp, Homo sapiens
gtatcaacgcagagtggccattaacggccggggatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390699 - DNA, 1438 bp, Homo sapiens
catataataattgtatggtctccctactgatctgaaactacagaaggcatttaaggaagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390700 - DNA, 612 bp, Homo sapiens
gtgccaagcaaccccttggcacttcaaggcaaccacaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390701 - DNA, 1161 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttcacagtatagacatatatttatattgaaagtcatagttttacttcctgcatcaattcccctgtctaatgttcccctatttacactcctttttttgttttctaatcaaatggaagtagtaaatgtatgtagccatgtattctaatttatttttttttcagatttcttgaacatttgagaggtagaagacattgaataaataagaagttatttatattgtactcaacaagtttaattgaatgggattgctggggtaggcactgatggaattgataatggaggtagtgattagggattcaaatggttgcttcctctatttaccacatttttttttttagatttattttggcccttgatctcattctcctttgcatgctttttttcttccttttgaatttagcaatttgtggctaggcacagtggcccact

SEQ ID NO: 390702 - DNA, 496 bp, Homo sapiens
agatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaagaatattattaaagagtatgat

SEQ ID NO: 390703 - DNA, 2630 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccgggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390704 - DNA, 2682 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaatctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390705 - DNA, 2817 bp, Homo sapiens
agcggagggggccgaaaaccagccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390706 - DNA, 1794 bp, Homo sapiens
tctgcattcaggttggcaggaacatcatctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacataaaaaaaaa

SEQ ID NO: 390707 - DNA, 857 bp, Homo sapiens
aaagaattttatatatagcatgattagtatatatagcaggatttgagatttgcctagttcattcaccttaactgctattaagtttgaatatacttccttttattgaatgataaatatttaggttcagtctcctttttattgaagtaagtttttcagtattttcagtgacagtctgtgactgtgtgcatacgtttgaaaatgtcatgatttcactttattttgaatagtaatttggctgcatataaaatacaggttgactgctagtttttattagcactttgccagtattgcttaattcttattcggcttctatcattgttgagaagtctgatatcagttaattatgatttcttttaatttttttctctagtttgttttaaaatattttccttttctgtggtgccctgcggtttcattaaaatatgtctccatgcatacatgattttccatttatcttgcttaggacttttcgctttgaacactccatctgccttcacttctgtataattcttggtcatgcttattttgaatattgcttttctcttatccttgctgttttctccaagtggaactcttattagacctgtgttagaccttcttagtttaccctttgtgtcttttaagccttctttcatattttccacatctttttaggttttatttgggtagaatttctcagtgttatcctttcagtacactaattctttcctcagctttgtctaatttactttttttgatggtgatatgtatatataacataaaatttattttaggccaggtgtggtggctcatgcctgtaatcccagcatttgggaaggccaaagcaggaggatcactggagcccaggagtttgagac

SEQ ID NO: 390708 - DNA, 553 bp, Homo sapiens
gagaagtaggagccttgtgcaaggattcaggagaggcctctagaaactgaggatggccctcaactggcaagcacaggcaactgaattcggccaggcatctgggtcctgtgctaggggctaggaagacaaagagaaacagagtcacatcctcccacaaaaatccatgagatgtcggagagccgaacttgtaaacagccatcatcaacacaaagaaggatgcactgatgctctctagaggctcacaggaaatgattcatgggcatagaggtgtgcaatttgcttcctgccccagccctgaccctgagatgcagcatggagggagtagaggggtggggtttgcgaagtcacttccagtcatcgtgggacctttatggaaacctgggctccactccacaggatgagtctcaactggaacccttgcccattgggctcactgttccaatctaaagggcaggctttccactactctttgggacttgtagtttgtgggtttttttcacatgcacatcatcttacttacagttccccaagaataaaagctttccatctcaat

SEQ ID NO: 390709 - DNA, 865 bp, Homo sapiens
gagaagtaggagccttgtgcaaggattcaggagaggcctctagaaactgaggatggccctcaactggcaagcacaggcaactgaattcggccaggcatctgggtcctgtgctaggggctaggaagacaaagagaaacagagtcacatcctcccacaaaaatccatgagatgtcggagagccgaacttgtaaacagccatcatcaacacaaagaaggatgcactgatgctctctagaggctcacaggaaatgattcatgggcatagagatgtggaacctacggacatggagggccaacttcacatataatgaaatattatttggccgtaaaaaggaaggaaatcctgccatttatgacaacatggatggacctggaggacattatgctaagtgaaataagctagacacaggaagccaaatactgcctcatctcacttctgtataaaacctaaactagttaaacacatagaagcagagaatagaatggtagttgccaggagctggagggaaggggaaatggggaagtattggccaaagagttcaatttgtgtaaagtttcagtgtgcaaaataagtaaattctggaaacctcctgtgcgatatagggcatatgattaacaccactatattgtgttttaaaaaatttgctaagaaggtagattaagaaaaacaaagaaaaccaaaaaacccaaaggcagcagaaggacacttttggagataatggaaaagtttatggcattaatattggtagtgatgatggttacatgggtgtatgcttatctccaaacacatcgagttgtatacattaaatatctatagcttcttgtatgtcaattatatctcaataaagcggtttaaaaaattgga

SEQ ID NO: 390710 - DNA, 228 bp, Homo sapiens
aaatccagcccaccgcctgttcttctacagcccgtgagctaagaatggtttttacatttttaaatggctaaaaaaataaagaggaatgatactccagggcatataaaaaactatataatactcacatctcagcgtccatatgggagcacagccatcctcattagttgcctattgtctaaggctgctttcaccctacagaagctgtatggcccacaaagcctgaagtgt

SEQ ID NO: 390711 - DNA, 746 bp, Homo sapiens
gcttctttcatttaccataatgttttcatccctgttgtatctgtactcttctttttttctggctaaataatcatctatggtatggatataccacactcatcaattatccatttatcgtttgatggacatttaggttgtttccatcttttagttattatgaagaatgctgctatgaacattcacgtataatttttttgtgtggacatatgttttcatttttcttagtcatatgccaaggagtgaaattgctgggtcacatggtaactctccttaaaattgtggaaacaaaatgtaattttaaaataatccatactttgcatgtagtgggtgaacctgcagaagggatattggaaggcattctgccagagatttgagttggtcacgatgtgtttgttttgaaagtagagcttgggttatcatggtttctgagttggctcctttctgttctctgtaaagcagaacttaactgggctgagtttcttcctaggaaggccccagttaactcacatgtcagcagggcctcactgtaagtttatctcactgaaagttagtcctttggtatggacacttcaattagtcagatatcattcattcttttcataggccttgaatctggaatccacttattcttcaaacagggaatgttcacagctagatcatgaaggtctatgggctataaatggttctgttggtgttttgcagtattataattcacagaattgtagagctagaagtccaagatgttg

SEQ ID NO: 390712 - DNA, 331 bp, Homo sapiens
ggggagggtgtcaagaaacgaactggctagatatgctggttctgagaaaaaccagcaagaacaagtcaatacataatgtccttcaaaccggagcatctggctcctgtcacaggcccctggggactgggtgaactcaggacagtggacatgattcattattgtgcttgaaaacagaatccgtacagacatctgtgaattctctggatcttgattccataatttctacttagatataggaagggaagaaaagatagtacgtagcctttttttctgttattaacaagtatctgaacaagcacaaacagaagtttggaaaattatcaggttttta

SEQ ID NO: 390713 - DNA, 403 bp, Homo sapiens
gtagctggagatagaaacattaatccagtgctggggtcatcgattcagcaaacagtggtagttaagtgtgcaggccgtctgtcctgtgctgggctctgccccctcaggaagatgcatggctctggcctcctggggctagtgctgcatgcttggcaattccaatggatggactttgcaaagcagaacgtcaaccatggcgtgagtgtgtggggaaggggcccttggaggcaagcatgtaagtataactggtaatggactgcacattcctaagaagaaaatgtgaatgtcatgaattcttacagaatattgttattttacaatatttttgcaagctttacatttataaataagtatttacaatctgcatttaattaaggtgaaagctcacagggtttgggtgttg

SEQ ID NO: 390714 - DNA, 554 bp, Homo sapiens
acaataaagggaaatgaagtattgataacatagtaacatagatgaatctcaaagaattatgtcaaatgaaagaagctatacaatcaggggtatatatggtatgattccatttatatagcattctaaaaaatgcaaattgagcttttggaggtggtggatatcttgattgtggtggtggtttcatgggtatgtacagatgtactgatcagatagacaatttaaatatatttaatagtttaaatgtaagtcagttatacctcattgaagctataaaacataggtaagctgatactattttcagtacctcaccaagcttcaattttctcatcagtgaagtaaaaataataatacctgcctcacagggatttttttaacattttgtgtgtggtatgtgtgtgcatgcgcacccatccacaatacctccgtatcactccttatcaggccttatttttcttcaaagcaattataattatgtatttaattgtttacctcccccaactatactgtaaattctttgagaacaaaaactttacctattgaccactaccttccca

SEQ ID NO: 390715 - DNA, 313 bp, Homo sapiens
caaattttgatcacaagttaggctcactactaattgaaacaactttcatgattgctgcaagaagcaagtcctttatatggcagtatttccttagttatgaacttagacttgctcatttaaagtgttataaagtaaaatgaatgttaattcttccacttagaagaaagattattttaaaatgtaccaacaggctgggcgcaagtgactcacggctgtaattccagccctttgggaggctgaggcgggtggattgcttgatcccgagagtttaagtccgcctgggtaacatggcaaaatcctgtctctacaaaat

SEQ ID NO: 390716 - DNA, 374 bp, Homo sapiens
cctattgtgaactgcactggggagggatctaggttgcatgcttcttatgagaatctaatgcctgatgatctgaggtgttacagtttcatcccaaaaccatcatcccttcatgctcttgcctctgtcacttccgccacacccctgtctgtggaaaaattgtcttccacaaaaccagtccctggttccaaaaaggttgggagccactagcctaaagagtagaggaactgtacattcctacatccaacttaattctggcccaggtatgctttcatggtgccttcaagaaaatgcaatatgcagcacctcattattcatacaaataggttctatttgttcagccgaaaaacattaattacatatagcagacaaaaaca

SEQ ID NO: 390717 - DNA, 720 bp, Homo sapiens
gtgagcggatcacctgagttcaggagtttgagaccagcctggccaacatgatgaaattccatctctactaaaactacaaaaattagctgggcgtggtggcgggcgcctgtaattccagctacttgggaggctgaggcaggagaatcacttgaacccgggaggaggagtttgcagtgagctgaaatcgcgccactgcactccagcctgggctacagagactccatctcaaaaaaaagaagaagaaaacagggagaaagtgttacagcgttgaatttagcaatgatttctcgaatgtgacaccaaaagcagagataaaaacagtaaaaatacataaaatagacatcaaaatttaaaatctgtgcattaaacaacacaatcaacagaataaaaaggaaacccatggaatgggagaaaatgcttgcaatttacatatatggtaaggcattaataacccaaatatatgaataactgctacaactcaacaacaacaaaataaacaacccaatgaaaaaatgggcaaaggacttgaacagatatttctccaaagatataaaaatggccaacgaccacatgaaaagatgctcaaaatcactaattttaggaaactgcaactcacaaaaagacaccgcctcacatccattgaggtgaccactaccaagaaaacaaaaaaccaaccaaccctacaaaataacaagtattagtgaggatctggagtaactg

SEQ ID NO: 390718 - DNA, 206 bp, Homo sapiens
tttactccttgtatcaactgccagaaatagtcagtcctgttatcttaaagagtcccactagctggctgcagtgggaccacaggagcgttaagtgcctctttccccacattacgtccttctgtgggcacatcctcacctgctgacttttttctgcaatgctcattgttttctcccgtcttaagagttactgatgaacactctttcct

SEQ ID NO: 390719 - DNA, 674 bp, Homo sapiens
gtgatctgttaaaaatggaaatcaggctaggcgaggtagctcaggcctgcaatcccagcactttgggaggccgaggtaggcggatcacgaggtcaggagtttgaaaccagcctggcccacatgctaaaaccccatctctactaaaaatacaaaaattagctgggcgtggtgatgggcacctgtaatcccagctactcaggaagctgagacaggagaatcacttgaacccaggaggtggaggttgcagtgagccgagatcacgccactgcactccagcctgggcgacagagcaagactccatctcaaaaaaaaaggaaatcggatcgtgttatcacctatataagtcctttgggtagctttctgtacacctggcatcaggtgaaaactactggcccagcctcaaagcccaacatgctcgtgcccctccaaattatctggccgcccctcactgcaagctgtcctcctgcctgttggtctttctcatccttggacacgtcaaattcttcctgccaactgttccctctgctgataatggctgctccaatcttcacattgatgggaacttcttgtcactcaggccttaagtgtcactactgtagtgggcctttcccagaccatccagtgtgagggcccccttcccacgccactccctccatcacctctgtctgtactga

SEQ ID NO: 390720 - DNA, 434 bp, Homo sapiens
gtaaataaacctgttctgccagtcataaaagcatagcacgtataattaggtacagtacataatacttgataaatattaacaattatgttactagtttatctactgtacttttagtagttattttatagagtgcacttctacttattttagaaaaaagtaaagtgtaaaacggcctcaggcaggcccttcaggaggtattccagaagaagacattgttttcgtaggtggcgatagctccatgcatgctattgcctctgaagacctttcagtggtactgtccagtgatactgatgattctggccttgggtaggcttaagttaacgggtgtgtgtgtgtttgtttttaacagtatttaaaagtgtgtgtttgtatttaaacagtaaaaaaaaaaattaaaaaatagaaaaaagcttatagaatcagaatataaagaa

SEQ ID NO: 390721 - DNA, 786 bp, Homo sapiens
tgaagaaaataaaacaggatgctgtgccatagtgtgcctggagctgccacttcacctctctatcagcttcattgttttatctgtaaaatggggctaatacagtcttgttatttgtggtagttccataaagttgaattgtagaactgaattaccaaatcttcaaccattgctcctaggggaaatacagggctaggttcctgcgagcctctggtcactttttcaacctgtcaatacataaccttattttatgtgtttctttttttttctttttttgagacagggtcttgctctgttgcccaggttagagtccagtgacatgatctcactcactgcagtttctgcctcccaggctcaagcaatcctcccacctcagcctcctgagtagctgagacctcaggtgtacaccaccacacctggctaatttttgtatttatttactttttggtagagacagggtttcgacatgttgcccaggctggtcttgaactcctgggctcaagcaatccactcacctgggcttcacctgctgagattacgggtatgagccactgaacctggcctgtttcatgtgtttctgtttatttttatttttaatttttatttttttgagacagtgtcctgctctgtcacccaggctgtatagtacgagagtgtatcataggccaggcacagtggctcacgcctgtaatgccagcactttgggaggccgaggcaggtggatcatgaggtcaggagttcgagaccagcctgacaaacatgctgaaaccccgtctctattaaaaatac

SEQ ID NO: 390722 - DNA, 211 bp, Homo sapiens
tccataaataagctgtttctgtaacctctaattcaagctagaatcaaacatgtgaaaaagaaaatattctactctatttcatgctaatgcctaagggctggtacataatacctgttaacttatgtacagtttaacaaaatatttttcacccatccatttataaatactcattgaacacctactatgggtcaggtgctattcgaggcacata

SEQ ID NO: 390723 - DNA, 262 bp, Homo sapiens
ggtggggaagatgcctgtctttgggacaagaaggagcaggttaaaggagatcaggagaaggtcagagagattatgttttctgaggcctgctcatgaggccttaaggcgcctcaacagtataacaaaagctatgggagttatgagctaggagctgcggacaaaaaccaacatgtatgtatgtcataatatcacagatggtaagcatggttattttctaatgtgtctaatttccaatatgcttagtcctgtttctgtttttagt

SEQ ID NO: 390724 - DNA, 330 bp, Homo sapiens
gcacgagataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctcta

SEQ ID NO: 390725 - DNA, 675 bp, Homo sapiens
gtgaaatatcagagcagcagctgttgtttacagtgggaattgtggagtttgtgggtggtagaggaatatagaaatcttggaaacacaactcttgaaattaaaaccaattctaaggtgagaagttaaaaaatatcaccatatctctgtgaacataatgaccagagccgaacgatcatttgtattacctcaattgaggtaggaactaccagcgagttataaaaatagccagggtgctttgatcaattgcgtacacgtggccactaatacattagacctatgataaaagatctttttggctttttaaactccaaacttttaaattccctctggaattgaaactatcttaaagatgggaagcagattgtgctcattttgcttttgttatgtctgggatatttctaatctcccttgcacgtataaaaatcattgttagtttcacacaatttaactttatagcaaggttctgctgcaagacacttctggaaagtgtcccagataaacaccattaaaatctccacatagctgcatagagaactgctgtcgccacaaaagtaagggaaggtggttcttgcactggagggttttcaaagcagcatttccgctttcaagtagctcatcagttggtttgttctcttcaaaaatggactcacccatttccaccagtgttctgcaacc

SEQ ID NO: 390726 - DNA, 679 bp, Homo sapiens
gtctagacaaaggcttgcaagcgtctagttttgtgctgtgtgcagctgctggcttaacacaatgtggaagccaccaagccttgaagcttgcaccctctgaagcagtgacccaagctgtacctgtgcatctttcagccaaggctggagctggagcctcaggaatgcagccagcagtgtcctgaggttggacatagcagtggggccatggggctggagaaggaaaccattcttttctcccagacctcagggcctgtgatagcaagcgctgctgcaaaagtctctgaaatgccttcaagacctttttaatattgtattggctattagcactgaactcctttttatgcacatttctgaagactttttgaactttcccactgataatcagcttttctttttggccacttggccaggcttcaaattatccaaacttttaagctctccttctcatttaaatacaagtttcaccttgaggtcatttctttggtcacatataggaccacaggctgttcgacacagacaggaaacctcttaagctttgctgcctaaaatttcattccaccaagtacactctaaattatcaccctgatgttcaaaatttcacaggtctccaggttaggggcattgtgcagcaacatcctttgctaaggaaaaaacaaaagtgaccttgactcctgttccc

SEQ ID NO: 390727 - DNA, 143 bp, Homo sapiens
tgcccagtggagaagtttagggaaaattatcttacatttttcatcgaagaactggtattgttgatttaaccgtcttttcccatcaccattgttcctatagcaatttttagactgggtggaggaatctacttctcatttcaatt

SEQ ID NO: 390728 - DNA, 543 bp, Homo sapiens
ccagaaagaaaatctcagaccagtaaagctctgaatggaggtttgatctcaataccaaggacaatataagcagagttgctttaaggatgctattgctgttgtccatgggaaagaccctttatgcctgaattattttgattccagattgaaggaaaaactgctaatttcagttcgttttatagaggctggagttttgggcattcctgtttgactgtaaactctcaataaggtagggaaataaatcagaaatcatgggtgtacatttttagagaccttgacagacttattttgcagttggggcttcagggcccagaatcttttagcatccctgccctagttgaaatcagacacaccctctccctggtatccaaacaaagctagttcaggtgctgccctgaagggatttggttgatgtgaagttccaagtccttaaattaatcaacaggagtactctcctggatgggcctgatttgatcaggtgggtgacatgtaagttctcctcctttacaggggaagacaccaggactcggagagtcccacttc

SEQ ID NO: 390729 - DNA, 284 bp, Homo sapiens
ctagcttctggaccctttccttgtgtaagtgggtttgctcttgaaaagaataagcaagataacacatgtggaagcctctagcatggacccactatacaggacatgtcaatcatttgtggggtttcaaactgaaatctttcttgatcaaaccctcaaacacacttctaattgcctgtttgctgtaacttgacttcaaatgtcttctcttttcaagtggaggtttcctgctgtggccccagggaatagctgctacctctgggcgctggtctgggcactgctgcctt

SEQ ID NO: 390730 - DNA, 244 bp, Homo sapiens
aaagaatgaatacacagtgggaagtaatggaatttgtattagttaatcaaacatatgttgttattttctttctttttttaactctcacttttgcatctttaaatagcacacttttttaatttatggaagacttgtattcttagaatcttgtttcaaaacagttcatgctaaatccagctatgccattctttgtattatttcttgccccaaaaagtaaaaaactgcttagcaattaaggccttca

SEQ ID NO: 390731 - DNA, 383 bp, Homo sapiens
tgtgcagcagctgaaactcctcctccgtcctgatgccagcctccaggcagccacagacatcctcttcagagaagtaggtcttgcgggaggacaccccctcataggccaacttgcccatggttcgggctgcataggccatcagggacaaattggaggggtcagtgctgtccagggtttccccgctgaagttgaggcgcaggaagctggtatagatgcttgtaagggtctgcccagcaggcgtgggggcatgcaggaagtgcaaggtggcacaaacgagccagcaataggacggcaggaagcaggcagcggctatctggtggtgcccctccaggttccgggagagcatctgcaccaggtggtcacgctgagctggtgtggcagag

SEQ ID NO: 390732 - DNA, 321 bp, Homo sapiens
gagtggagtggagtagaactcttgagtgaatttagaagcatgagctaagggatgatctaaggtggaggattatctttgcagtcccctctttccccagtggtacttctctgactgctgctcctccatagaaatggagcacaggagacccttgctgttcatgggtgtttgtctttgggttcccacaaatagggcagtctgagatattatgtaacctggtgataaggatttgtgtggaaaagaggactcctactcccatcatccagacaccttttttcctcccaagcttttgtttccatattgtattcatttattgccagttgc

SEQ ID NO: 390733 - DNA, 514 bp, Homo sapiens
tacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagc

SEQ ID NO: 390734 - DNA, 286 bp, Homo sapiens
cggaccttgcctgataactcttccatctcagtgtagtttaaatctgttcttgcaatctgtatggacactctaggtagccttctggcattgctactgcagcagccttggaacgtgatttgggacacaacacagctcaatttcaggcacagtggttggcttttaaagtgctgtttttttggagagggagtctctcgctctgtcacccaggctggagtgcagtggcacgatcttggctcactgcagcctttgcctttgggttcaagtgattctcatgcctcagcctccc

SEQ ID NO: 390735 - DNA, 341 bp, Homo sapiens
cccagttatcagaggtcaactgcagtctgaaaatattaaatggaaaattccagaaacaattaatgagttttaatttgtgagcagttctgagtagcataataaaatctcacaccatcctggctctacctgctgtagatgctacctgcccattagtcacttgtagctgcctcggttatcagattgtaaaaacagtattatgcagggttcggtactatctgcagtttcaggcactaagtggtgagtcttggatcacatacccacagataaggggagactactgtaaaagttactagcaattcacacaaatctatcaatgctaataatagtttatcttgtgtgct

SEQ ID NO: 390736 - DNA, 603 bp, Homo sapiens
tcaggtaaaggtttaccattttagctggatgtggtggctcatgcctataatcccaacactttgtgaggccaggagttcaagaccaacctgggcaacatagcaagaccccatctgttttaaaaaatgtagctgaatgtggtgatgtgtgcctgtagtcctagctactcgagagactgaggtgccggtgtagcttgagcccacgagtttgaggatacaatgagctatgattgcaccactgcacgtcagaatgagaccctgtctctagaaaataaaaaatgataaaagaaagctttgacttatttgagcacgtgagaaaggggaagaggaagaaacctttattaaatgcagatttaaatgccttgtgcagtcttaggcattatttactcatcataaaaaccctataaaatagctattagcattttcaaattagagattggaaaacaaacgtttagacggttcaagtcctttaaactaggccgtatagagtagaaagtatataagcatgtgaatgatacaacaagaagtaaacagaaaccaattcagtatatgtctggccaatgaggtatgattctgagtccacacacacatacacacacacatgca

SEQ ID NO: 390737 - DNA, 407 bp, Homo sapiens
tatcctgtagaccacaaagcgagcagagaattgttgtgcatgagaatgacatgatcagccctgttttttaggaaaaaagcttgacagctggggttggagaaatgagagaaaaggaagcaggaaaacagtgggattatgaactgaggcagtggcattgggaatggagcgggcatatattaagagacatttctgatgtagaattgatgagaatccatagccagttagttgcaggaggggtaacagaaaatatactcgtgtaacaaacctgcacttgtatcccctgaatctaaaataaaaattgaaattacttaaaaattttaagaaagaaagaaagaaaaatggagaaaccaaggacaggactggcatgtcaagtttgggagattgtataaacagtattcaacttagtt

SEQ ID NO: 390738 - DNA, 268 bp, Homo sapiens
aattcttactgacaggtagaccctcaaaatttggggtagatctcttttattttaagtagcattactatgaatgtaaatgtctagctttctaactttatttgaagaatagcaaattgttaaattaagtttgacctggatgcagtggctcatgcctgtaataccacactttgggaagccaagacaggaggatcgcttgatcccagaagttaagaccagccttggcaacacaacatgaccctgtctctataaagaaaacaaaaatgaaaaa

SEQ ID NO: 390739 - DNA, 486 bp, Homo sapiens
agatattaagcatgtgttcaacattagcccccaagcaaggggggacacaccttcactggggggagtgtgactctcctactagcccggcaagtgaactattcacacttcaggaaggagacatgcttaggaatttccattaagcagtaagcaacgtctttgatcttttcacctgcaggttttcgaggtgtgtgtgcatgtgtatacgtgcacatgctacacagagctcctcgacaagcacctgggagtccgcctgtgctgataaaatgacttacgtagaatcagggcagggaggaagtggcttttgccttggagcctcttcaagtctaggtttggcttgtctctcgagaagggtctatacagctgagagacacatggacagttctgacaggaggcaagttcatctcacaactttaaacatacccatatgttctcatcatttagctcccacttataagtgagaacatgcacaaagaggggaacaacaca

SEQ ID NO: 390740 - DNA, 646 bp, Homo sapiens
gtgtcatcgtttcctttcccttctgggttttgttttgttttgttttaatgtatgagaaactgccttactgaggaaggagaatcacttaaatggtactcggtgcctgccctgtccttctctcgccttggggaaagaaagaaagaaataacatccgctccttgatctgtatgcacaggagaaacagaacaccctgtactttctgagcagataaaggagagaagaaaaaagtgctggctcagccaggcagggaagaggaggagggcgggcaacagacacttgccttcttgctcctgcttccatggcaaagtgggggtgtgagcctcttgcccagcgcctgcacccacgccttgaggttattctccatgtccccaagcaggcaatgcctaggagtgccaagaaatcaggccagccagggcatgagtgcaccccccggtcccctggcaatttcatccaagataccacgcagccagttctccagcctgcaggccaccgcctcccccagctgtccagagccaccaccaccctgactgaagtgtcccaagaggccacattggacacaggaaggcagcagggtatggagagaggaaaagagggaggaaaaaccccgtcctgtggcagggttgccaaagacggatgaatagaataa

SEQ ID NO: 390741 - DNA, 329 bp, Homo sapiens
ttcagtggaggctctgtacatccaggtgttgaggggtcctggctgcaaaatgcagtcatgtgtcatgtgttgaaactgtagcaaaagggatgaatgctcttttcagtctggtttgctttggtaatgttcttgtagaccaactacacgtttttgtttctttctacaggaataatattaagtatatgtaaaaatgccactgcaaatttgatgttgtttagtaagggcagttagctatctgtaaaaccagcagaaaaatatgctgtgttattggctaataatatacctatttttagaggaaataattttttcttgtctaatttttagccaga

SEQ ID NO: 390742 - DNA, 432 bp, Homo sapiens
caaagaggagccaggtcatgtatacatgatgattagggtagagaaactgactaccctttatcagtagagccaaacttccggatggatagggtgagggagtcaaggatgaagacaacattggtaattggttaatagcaagaatacagttgacagtaactgagatagttgtgaacggagaaagggaagggggatatgagtcaaattttcaaaacacaaagttggaaatatctgttagatgcccaagtaggatttcaaaataggtagtgagatctagaaatctggattggaggaactagttgggggatttataaatgtggttttaagccataaattgggatgagatcacacacaaaaaagagtaaattgaatgaataaatggtggcttatttacttaatgcaatattagtcatctatataacaatgacttcttat

SEQ ID NO: 390743 - DNA, 148 bp, Homo sapiens
gggatggatgagtgattttccctgcaggccgctcagtcccaccacaaatatttgagaatagtggggaagaacaaacagagacttatgtgccaagagactaatatttaacagctataaatcaaactatcacactgttgactaaaacgtg

SEQ ID NO: 390744 - DNA, 549 bp, Homo sapiens
ttgttctgactactaaaagggggtgaaaagactgtaaaaaaaaattggttgaatttttgctgaattcttgccagtctgtgtaaaaactagaataacttacacttatttccaaagaactctatatttgaaaaacgttcacatattaacattgcaatgtgttctcaaagaactttaaaattaagtgacattacagttcaaatcacatattatgataattcaaattaatggctccttgggaaaaaacctttgtaatgaaacagatgaagttgaaaaattaatacattgtgctaagcaaaactgtattgttcaaaactgcacacaacaaaaacatatcgtaattcctttccctcagttgaataaaccctgtgtttaaaaaaactaaaacaaagcctgttgtaaagtctgcaatctgtcttatgcatctcatgtcttttccttccagatttttcccccgttccctagttcatgtgactaataccttcataatcaatttaccatcttcctatcaaaacagtaatgtgttttaaacctgctgtgactaattgtaaa

SEQ ID NO: 390745 - DNA, 244 bp, Homo sapiens
agaaactgtgaaactgaaattacttacattatttgataagctaaacccaaaattcatgaggaagagaataagtaaaacaaacaaacaaacagaaacccagacgtttataatggacaaataattgttcactcatatttgttgtccttcctggaggtgaccctcccagtgggaatatcacatatttttgctccattaattcaggagtggtcgagtgattttcttcagccagtgagacagcatagaa

SEQ ID NO: 390746 - DNA, 531 bp, Homo sapiens
actcagggatgggcacctgggttccaatccttgttgctccattcactagctgtgtgcccctgggcaagtcacttcactgtcctagaattcagttgacttatctgtaatattggaagaatagcgcctgggaagtagcgaggaccagataaattgtaaatgtacccagcccagtgctgacacatagtaactcggtggcagttgcaggccaggggaacagttgttaactcatcaccagaggggccagaactgggcagggggaaaggtgtcctgagtgggagatccaggtcttggggtgctccgactctggatctctgggaagaggaatccccaactctgcttcccaagtagctagaaactgacttaggagggggacagcgtatagggaacactgaaatgctgctgtaaacgatggctggagttagcctcatctgaactctgtgtttgagggtacacactctgaagtcagatgatacggattcagatctgcctctattatatactatgggacaagtgacttcacttctctgtgcc

SEQ ID NO: 390747 - DNA, 341 bp, Homo sapiens
tgcagctgagcggtgacctcagccagtgtcacaaggagcagaagagacatccagctgagccctttaaaaattcctgacccacaagcaggactgaatcacttaacgttgtcttgcttgagtgctttgacccgccatctcctcctcctaccaactcttaattccgaggcaagagaatcctcccaagaggaggccactagtagcagagctgaaacaaaagcctcagaagcagtggggaagcattttacctgcagctctggaaaacgacctactgaagaaagtttcagatggggaaacatttagatttgacctaaatggggaaaaaaagtttataatagaaggac

SEQ ID NO: 390748 - DNA, 1931 bp, Homo sapiens
  misc_feature (3)..(3): n is a, c, g, or t
  misc_feature (5)..(5): n is a, c, g, or t
  misc_feature (10)..(11): n is a, c, g, or t
  misc_feature (1513)..(1513): n is a, c, g, or t
ccnangcgtnnggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttntggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagagggagtctctgtctcaaataaagaaaaaaaaaaagataaaaataatttttaaaaagtaaagataggcctgggcaacagagtgagactctgtctcaaataaaga

SEQ ID NO: 390749 - DNA, 489 bp, Homo sapiens
  misc_feature (3)..(3): n is a, c, g, or t
  misc_feature (5)..(5): n is a, c, g, or t
  misc_feature (10)..(11): n is a, c, g, or t
ccnangcgtnnggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcgggtgagaacatcttttccttaggtgtgcggcgcagggcagtattggcctggtgcctggcgtcaggtggggatgccaaggtgcaccgactgcccagcac

SEQ ID NO: 390750 - DNA, 1888 bp, Homo sapiens
  misc_feature (3)..(3): n is a, c, g, or t
  misc_feature (5)..(5): n is a, c, g, or t
  misc_feature (10)..(11): n is a, c, g, or t
  misc_feature (1513)..(1513): n is a, c, g, or t
ccnangcgtnnggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttntggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagagggagtcagcctggtgacagcgtgagactctttaaaaaaagaaattaaaagagttgagac

SEQ ID NO: 390751 - DNA, 1563 bp, Homo sapiens
  misc_feature (1145)..(1145): n is a, c, g, or t
tctgagtcctgctgtcctcctcagaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttntggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagagggagtctctgtctcaaataaagaaaaaaaaaaagataaaaataatttttaaaaagtaaagataggcctgggcaacagagtgagactctgtctcaaataaaga

SEQ ID NO: 390752 - DNA, 153 bp, Homo sapiens
ggatgctttcagagggtctaggctcagttccatactcctgggctgcattctctaaccctgggtctatagctttgtcctctggtccctcgaggtcaagtcctacctgggctggagtggccaagttattccagtactgctggcaacagcattctt

SEQ ID NO: 390753 - DNA, 667 bp, Homo sapiens
ggcacctggcccagtcacatatcatgtggaacttttctatgtggagaaaactctgtaggtatattgttttccaaattgacatttgtgttttatgggaaaaacgcagatgagctagagtaggctcaatttttcattaagtgtgcattggggaaaatctgagctttcttccttcctgtggttcgagttctatttccagttgttaattgggaagttgaatgcctgacagctgggccaagtaaattgattgccataaagaaagcaacacactctgaggaaagcactggaagtctgcgactacttgttgttatgtgacacaaggcagccaaaataatcagacttttttgctaagcatatggttgccaaagataattcccagaagtcttcattcaaggaggccgaaatctcagtgttcaatatagaggatatataacattagatagtgtaagagattcagagtacctttaaactctggttttgcaatgtctggtcaccttgcaaacttatgggatagctgtgttatcatggatatgatgtaatgctgaaaatgacacaaaattttgtctgttttgtctctgttttgctttaagagaagtagctagatgcaaagtgatgaagataaatgccctcttctttctttggggagttacatgtttccatgggaatacat

SEQ ID NO: 390754 - DNA, 731 bp, Homo sapiens
agcctgggcgacagagccagactccatcacaaaaaaaaacaaaaacaaacaaacaaaaaccaaccctcccagagctctcagctcactcggtaaaagccaggtcctgacacgggcattcgtggtcccacacgagagcctgcctgctgcttcttcaatcacacctcttaccacccatggccccttgctcactccactcgaaacccggaggtctcctttctgtttctgcctcaggacctttgcactggctgtcttccaacctgaaaggttgcttttgcccttggttcctccaggtcttgactcaaatgtcatcttaccagtaaagtcttttcaccttggcagtttttatccctctttcttgctcagtttttgttttatattacattgcacttaacaccattccatacttaataccaaacaacgtcttctttgtttattatctgtctccccctaaaatgtaagttccatgagatttttttttttcattgctatatccaaaatgcctagagttgttactggaacatagtaggtggtctgtacacatgaaccaaatgaatgagttattttgaagatcaaagacaatgaatgtgaaagtactgtacaaatgtacaatgtttggttattcatatgaaaatgaagtttccttgatacaccaaagtctacaccagtagaatcgaatttgtgatgtttgaaaaaagcaaataacaaaaataaaaattttcagttggaaaact

SEQ ID NO: 390755 - DNA, 108 bp, Homo sapiens
gcacaaatcattttgttatataaacttctctggcagttacaggaatataattttctggggatatgctaaaccaagcccactgataagagtaacagaccaaaggaaaca

SEQ ID NO: 390756 - DNA, 476 bp, Homo sapiens
accaaggagagaaaggacgctctgaaatgctccaaccataaaagtggggtgggggagttagggactcggtgagtctgagcaggagactgtggactcttccagatgggagctggcagccagtgcagctgtgcagggagcgctggccccaggggagaaggtggtgggccctgagatgtggaaggccgagcttggccacaagaggaccagagaggtatggcttaaggctggagttagggtggctctctgggcatctgccacggcaaaagcagcttggagcagaaccttgaagtcctgggcaagtgcaaaaaccacaccccagggggagagaaaatacttttgtattttgggggagatgagatttctagagtaactccgggcctggtcaagtgggactttgaaggcccgatgaaggtcaaggcctgatgggggctcaggaacaggccaggaacagcaggttgggaagctggacctatgct

SEQ ID NO: 390757 - DNA, 140 bp, Homo sapiens
atagaagaggtatcacagaaacagacccaagtgttgaaaaattgtaacatatgataaagatgaattataaattatcaagaaaatgatacattgttgaagactggtgctgggacaatcgacaagctgaagaactggtaaaa

SEQ ID NO: 390758 - DNA, 889 bp, Homo sapiens
tgatcatattctgcttgtaagtacattgagtctaaaatctcaagaacaaaagatactgagaacataattaagaggatgtataatgttcatgtatcattgtgtgatgggaaaagtccctcctttataaaataaggagctgaatcagatgattccttaagattctttcctaattcattaagagcatggctttgatgtatgacagacttaggttcaatagctggctatgtgacctcaagcaaggcatagcttctttgggtctgtttttctcagctgaaaaaaaaaaaaaggtatagaagtaatacctaacttacgagattgtcagtactaattaaaaatgatgtatacacagtatttagcactgttattagcattctctattattttattgtttatatttttacttgaatattcatttggatataatacttttagtaagcacttcatgatttacagagataatctaggtgaagaatagaatcttggacaattaagacaggtatgaaccaacttcccacccaatacagatctttggcaggtggttatccaaactctgcttgaatatgtcctggaactgcaaaaaagaaaacaaaaaaatcgataaccttatcacccattgttaatttctgatatatactagtctagacttttcctatgcctttatacattttttaaaacaaaataaaattttttttctatgctacatatttttaatgaggttataacattatcatgttttgcccctaaggtattttaccatcagtgagtataggtctgtggtgtcatttgtattgactatgtataaattcatctgtgacttaaccataatttaaccaataccctattttttctttttgcgcatttggacattcattcattaaacaaatacttc

SEQ ID NO: 390759 - DNA, 303 bp, Homo sapiens
aagatggcaccaccgcactccagcctgggtgacagagcaagactctgttcccccagaaaaagaaaaacaataaacattgttttctgaaagatgtgctgaaaggtaggctggggattggatgatccaggatggtgtcagctggtcatatgggtttggagacacaggtttggtgggactgtgcctctggttgagctgattttatttattctgggtcccaggctgcctagggaaggtctcctcttggtgagggcagaagtgtgagagggcacgtagcaacacatgcacctcctaaagcttaggcat

SEQ ID NO: 390760 - DNA, 483 bp, Homo sapiens
tggaagggaagtcttatcagtgtcggtgctaatgacatccaccacacaggaaggatcaatcagacacaaagcagagttcctggaaatgaacaaatatggtggccaaaatcaacactttttaacaagggaactgaataacagagaaacctgtaagacagataacacctcccagaagaaaaacaggagggaggaaaaaatgagagaaaagctacaggatgcttggaagagatgcaggaagtctaatattccctgtggtgcctacaggacatacagggaacgatgcaggagaagaaatcatcagagagatcacaggagaaaaatgtcctgagctaaaggaagattcacacgtccagactgaagccaaggggttgagctccaaggaggatgaacggaaaaagcaaaccaaagcccctttagacacttgggagctcctggtctcagacaatgggtgacagcgccttagctctttactacatgcactca

SEQ ID NO: 390761 - DNA, 467 bp, Homo sapiens
aggaagagatttattacagctgtggggattaactgtattctcctggaagttgattttctgataggttaatgcaaaagtcattgcaaaaactgctattacttttgcgccaatttaatagttcacttgtttactttttaacctatattggcttaaattcactttttagcccctctttgtcataaggttctgtgctgcatttgctacaatagaagctcctatggttttaaagaaagttcagtgttttgtcagtgtcaagtgctacttgatgattatatttgtctggaacagtattcacttaagtctgtttatagcaatcccttttttgacaaaatttacaaagttggcatttttactttaaattccatctctatcagtgacttcctaaaaagagcaacttagaaattgggggaaaaatgtttttaaagcccaaatgctccagtttttattcaaagtcaaagtcgttattc

SEQ ID NO: 390762 - DNA, 419 bp, Homo sapiens
ctgctcaagtcttttgctcattttaaaaatttggttgtttactatttatttgtcctttgtgaagtatacgtgttgtgaatatttttttccagtttgtggttcatctattcattttctcagtgatgtctcttatggacagcaatttcttattttgatgaaattcaatgtatcttttttaaattttaggaagtggtaggcagagaagcccctctctgacaaaaagtacctatgtcctaatcctcagaaactatgaatagattacattacatggcaaaagggactttacagatgtgattaagtgatcttcagatggattatgcagatgggctcaatctatcacaggagcccttaaaaatagaagaggaaggccttagggtgaatcataaagatataacaatggaagaagaggcaggagagat

SEQ ID NO: 390763 - DNA, 350 bp, Homo sapiens
ctcgctctgttagtttcatgtttcaacagacggaattcagatggattggttgaaatgatttttacttagaaccatcaggctaacaaagaactttctaggctgggcacagtcactcacgcctgtaatcccagcactttggatggccgagacaggcagagcacatgaggccaggagttcgagaccagcctggccaacatagtaaaaccccgtctctactaaaaatacaaaaattagccaggtgtggtggcagacacctataatcccagctacttgggaggctgaggcatgagaattgcttgaatccagcaggcagaggttgcagtgagccgagatcgcgccactgcactcca

SEQ ID NO: 390764 - DNA, 294 bp, Homo sapiens
cgtgagcagacacaagcccaggtgaccacgctgaagcccttcatccctggcacatgtggctgggttacactggacccttaaaaatgcttgtcctctcccgaccttgggctgaggcctcttgtacttcagttccgcaccttagctgctctctgacgggtcttaggtgttgaaatagtatttttacccccgtttgctgacatagtgaataacaacttagtcctgcctattttagtgctggtagaaaataaaaaagaaagcaatgacttagaacaagatgtttcatgaaaatgttgg

SEQ ID NO: 390765 - DNA, 317 bp, Homo sapiens
agaatacttaaactgccttttacatatttcctttggaagtctcattgccaccacctcaaactcactatttcccaaactcattgttttcctcttcagaatgttcttctttcggtggcagcatccatacagttggcctagccagaaacctgaaagtcatcattgactcttccttctcccttctgcctcatatcctgttccttaaccctgtcagtttcaaagcctaaagaactcttgtatctttgacttctatttgttcctattgccaccaacatcttagccatgttagcatcatcaccatgtgatcactggggtggttt

SEQ ID NO: 390766 - DNA, 272 bp, Homo sapiens
aggatgagtttggtctggggagaaccaggagcctagaatccttttttctcctggtcccatctggctggatttctctgtcactggcactgggtggcctgggtggggctgcacatggggcaggaccccagggccgaatgacctgcaagtggggcagctcagccaggcctttggaaacccagcctctcgctcctgcttgagggtctcatgaagaaccctgggccctggcaggaatcccttgagccgcccacaactccagagcctgggtcaggatg

SEQ ID NO: 390767 - DNA, 335 bp, Homo sapiens
tgacatcatgtgattggcaaagcgtgaagcagtcaccacttggcctcttacaaagaaagcttgctgaccccggctatgcacagggtgaagcccctgagatgtttagaaggtatctctgttggctacttggggggcggtttgatggagaacaaggagagcacgcttgctccagtaccgtattctttcttctcacaggcccccaaaactccgtcagtctctttctcttccccagagccgtcagctcctgctggaacctcctgtctctctctctgctggggactccacaaagggaagcatggcccagcattccacctccccctgcccctaagactggg

SEQ ID NO: 390768 - DNA, 408 bp, Homo sapiens
ttgaatgtgtgaacctggtcggctgactcagcgtgattaagattgacgtcttagtaatgcgttacgaaacccgagttgatagtccatctacccctagaaactgcagctgtatcaacatttccatacacgattcttacacatctataaagtgaaatagactatactggaggaatgaagcagccaatgcatgcaacaagtcatataggcaataatgttgcttgcaaaggagtgttcgttttgtttagctttgtttttcaaatggggtttcaccatgttggccaggctggacttgaactcctgacctcaggtgatccacccacctcgttctcccaaagtgctgggattataggcgtgagccactgcgcccggccaacagcttctttttttaatgttatttttctgtttgta

SEQ ID NO: 390769 - DNA, 423 bp, Homo sapiens
taagacgcggtaggtagtgagaaatcccttctacttacaataccccagcccgcggtgtggctccggctgcggggctgttttattgctgtctccctttctttctctctctctctctccctctctctctccccctctctctttttttttctcggggtacaggcttgtttttcaaaggacagttgaattgcacgtcagaaacagggagaccgagcctgcgattttcctgacgaatacatatctattctgcaacctcggcattaattatttaatgaatcacgtgaccgggagggggaagggggtctttcgatttcaggctcaaaggaccactatgaccttccccttcaggaggagaaattttcctgcaaaataagttccccctcaacccaccaatggaacagtagtgaggtctccgtctgtctccca

SEQ ID NO: 390770 - DNA, 327 bp, Homo sapiens
aattaaggaggaggtgttgtactctaaggaagctatctggatgctgctggctgaaatacagatttgatctcctcgtgctggttagctaacatcgattttctgccccagtggaagagatttcactctgatgcatgccatttaaattcattttacacagctgcttaatgtggtttggcaaggcacagtcaaactagctttgtgggtctaaagaggcctctggagttggtaaaaggacagatcctatggattagctgcagatgatgaatgcttgcttcctccgactgttatcttcctactgactcatgaattgaccttgaaggtaccaca

SEQ ID NO: 390771 - DNA, 336 bp, Homo sapiens
  misc_feature (167)..(167): n is a, c, g, or t
tttgggtctttgctatttaaacagagtggtcagggaagcgctcctaaagatacgacatcggccaggcgcagtggctcatgcctggaatcccagcactttgggaacatgaataacacagacaaagtccctcatgaaattcattctctagcaaggaagcaagaaacagnaaaaactaattctttctggagtgacaggctgtgaaggaaaatatagcagagaatgatcagagaaaacaagggaagggcgggggatgctatttaaacagagtggtcagggaagcgctcctaaagatatgacatcggccaggcgcagtgtctcatgcctggaatcccagca

SEQ ID NO: 390772 - DNA, 229 bp, Homo sapiens
atctgccctggagggtgggtccggccaacactgtggagagggcgcagtgctcttttgggggacacttatgttccaagcaacaggccttccaggtacccctggtccaggccctaccctagctcccctgaaggagggtggcagggacgacgatggctgtcactcttttctgctttggaaaaagtagcccagaggaagggcactgcctgctgccaaccccctttgggggaag

SEQ ID NO: 390773 - DNA, 303 bp, Homo sapiens
ggagtccccaacctcacagaagccacaggatcacattctgggttgggtatagacttgcctaccagcccagtggaagatactctaacccaaactttccacaagtttggtcctcaaggcatctgcattaagatcacctagtgagactgatacaatccaagttcctcagtccactccacacttgctggatccaattctctagtaatatatttccaaaatctccatttttaagaaagccccaaatacaactggcgactgttgaaatccaaggactgctctccttcctacttttttgttgttgtttaa

SEQ ID NO: 390774 - DNA, 851 bp, Homo sapiens
catttacaatgatcagtgaagggttggtactgatttaaacagacagctgaattatccaattacactttcttgtgtttttgtacgaactgtacagtcctttggcctccttgatccacagttttctgcacttcatggtatatatctgctgagttattaaaaataataatctatcattaatcaagtctaaatattcatcaagccaattctcctccatagggataacatcccaacaggactttaattcagtctctcaatgtatttgatcatcatcatcagtattatactaaattttataagctcctaaaatattaattttacctgacccctatattacatcatatagcagtaccattgaagtgagaagtcagacaaaatttagctgctaaaggcttacattaaaataaaaattaaggccaggtgtggtggctcacacctgtaatcccagcactttgggaggctgaggcaggagaatcacttaagcttaggagttcaagactagcctgggcaacatggagagacccccccatctctacaaaaatttttttaaaatagccaagtgtggtggtcccaactgcttgggaggctgaggtaggacgatcacttgagctggggcagttgaagctgcgatgagatgtgatcgtgccactgcactccagcctgggcaacagagtgagaccacatctcaaaaaagaataataaaattttaaaaaataaaattaacaaataagatggctggatgcagtggctcacgcctataatcccaacactttgggaggccaaggtgggcagatcacttgagcccaggagttcaagcccagcctgggcaacatggtgaaaccctgtctctgcaa

SEQ ID NO: 390775 - DNA, 475 bp, Homo sapiens
cacggtggctcacacctgtaatcccagaactttgggaggctgaggtgggcagatcacttgagatcagtagtttgagaccagccttgccaacatggtgaaaccccatccctactacaaatacaaaaaatagccgggcatggtggcaggtgcctgtaatcccagctacttgggaggctgaggcacgagaatcacttgaacccgggaggcagaggttgcagtgagctgagatccactgtactccagcctgggcaatagagcaagactcagtctcaaaaaaaagaaaaaggaaaggaaaaaataattgctgaacctgaggtttcatttcaccatgtcaaaacgagctcactagctgggcacggtggctgaggtaggatcacttgcctgggagacacaggtttcagtgtgctgagatggcgtcgctgcactccaacctgggagacagagtgagaccccatctcaacaacaaccaaaaaaa

SEQ ID NO: 390776 - DNA, 458 bp, Homo sapiens
ctgtgcctggatgtgcaggtaggccagatttatgtttcactttatgcaaatatctcagtgtagcaaagagtaacagagcagtattgctgccagcatatcttgcctcccacagggcggttttctcctatttcagaatagaatgaatggtcggctttacacagagacattccattccccggaacgagcaggagacagaagccttcctcttatctcaactgcaaagaggcctccctctttcactattcctcctcagcacagaccctttaggggtgtcaggctgggggatggtaaggtctttcctttcccacgaggccggatctcaggctgtctcagtgggggaaaaccttggacaatacccaggctttgttgggcagaggtccctgcggctttccgcagtgcactgtgcccctggttaaccgagaatggagaatggtgatgacttttaccaagcatactgc

SEQ ID NO: 390777 - DNA, 559 bp, Homo sapiens
aactaggggcacgcatgggcagagtgacactcaaaggaggggctgggatttgccttttacacttacttatgagttcttttactgcatatcctcaaataactcactatctatagcaacaagttaacaaagataaaagacaataacaaaaatgagaacaacaatggcatgaaaaaggacaccttcaaggggataaaaacagaatagaggtattacttaatgagagaaaatagttttggttgatgactatacacagtatagatgatgtttaaaaattaccattcaacatatatttaatgagcacctgttatatggcagatattgtgctagtcacagtattcatagtctttattttaaaaaatatcccagcataaagtttatttctaaaatgtaattattatttagtatgaaaatgattagattcaaggaatgagctgtagaatttcagagaagggaatcataagattcgggaagaatgctatagaggaagggccatgggaacagattcttgacacgtgaatgggacagtgaccagcagagatggaatgaagtgtgtgtcaga

SEQ ID NO: 390778 - DNA, 576 bp, Homo sapiens
gggcctggaccccgctgggttcacaagaagtccccagcgctagcccggggctcagcagggaccacagtgtgtatgtaaataaatgaatgccgcccaccctttctgaccccaccgcagccagacgcagcggcgacatggggcgtttgtgtctgaattccccctccagcccggatccatcctcagaacctcctttggccaggaccagatcctggagaccctggaggggctccctcgtcctctcctgcccccatctttgaggaaatgatgtcatcattttttttggcattcacttccaaacctgctgatgaaaagtcaaagcttatttttttccctattcgcagtgctgcacacccgcctcctctatcaagtttcaaaacctttgcatcactgccctgtaaaaccctgtaaccattagcaggcctcattcctgcctcaccctgccctcctggtagccaccagtctcctttctgcctcgtggatgtgcctgttctggacatttcatatccgtggagtcaggcagttcgtggccttttgtgtctggcctctttggttcagcatgacattttctggttatgt

SEQ ID NO: 390779 - DNA, 406 bp, Homo sapiens
acccaacacttctaagacatgtcagcatgtgccttgctgaaacaggtgacatttaagtcaaatctcgaaaaaggagcaagctgaggttcatttcatgacatgacactgcctctcaagtgagaagagaataaaaaatgtccatctgattctgaaactgtaaagatactaatgaccttagtaagcaatgtggagtggagccaagtggaagagctgaatagctgtgaagctctcctggttctcaggcttttagaattggaatggaatctacaccaccaggtctctggctttcaggccttcaaaccacacaactggctttcctgggtctccagcttgcagacagcagatcatgggacttctcagtctccataattgcatgagccaatatgttataaaaaactctttttat

SEQ ID NO: 390780 - DNA, 296 bp, Homo sapiens
gccggctgggcgggaccaggcctttgtatctgcggtgcggaggtggagcagaggagagggtgcccggtgtccccctccctcgccccgcagactgcccctcctttcccacctccactctcagtcccctggggtctgatctctcctcgtctggccttcccctccctgtgctcgcatttggggtccaggcccccagccttccctcagacagccactgtgccccaccttatacaatttcttttctttcttttttttttttgagacatagtctccctcggttgcccaggctggaaagcagt

SEQ ID NO: 390781 - DNA, 212 bp, Homo sapiens
gggggagcttggggccaggccaaaggcatctgcagaaagaagacctactgccttgggactcagcccggctggaggctcagaggctgcagagcacgggcctgggggcagggaaggagctgggtggacaaggagtcgaggccctgcctacagtgatcgctgacgggccaggccccacccaccacacccctgcctggtgtcccccagcctggccc

SEQ ID NO: 390782 - DNA, 527 bp, Homo sapiens
agtggtagcatctcatgctcactgcaactccactttactgggttcaagcgattctcatgcctcagctcccaagcagctgggattacaggcgcctgcaccaagcctcgtaaatttttgtatttttagtagagatggggtttctccatgttggtcaggctggtcttgaactcctgacctcagttgatctgcctgcctcccaaagtgctgggattacaggcctgagccaccatgttcagcccatccagagaatttaaatgttcttctgagggcagagtaaatgcatatttggggactatccctaatgaatgaaaattggctttggcttcctaatggaaaagaaggcatgagccaaatctagtacagaatactgatctctctgagcttgcagcacagctttagttgttgatgccatatcagatatagctgatcaaatggggtgacaccaatttatcaagtcttccgtaatctatagttaatttaccagatccatcagcttttcttccaggccatcctagaccgaggctgga

SEQ ID NO: 390783 - DNA, 719 bp, Homo sapiens
aagtgtagcaaataagccatgtacatttaatgtgttctacttgctagtattaactgtatgattaatgaatgtgttatttaatgcccaagtttgttaacttttattctagaaatcatcctctgaatttattataaatcacagatttcattgtgctctatatttagtcattctcagttgaattctagaatattccacagtacagtataagaaagtattagaaccaacttgcttgaactattttgaaccagtgttgtaattctatatgttaatcagtatttagcatttctgctccttttgagatgatgatggtttaacttcaggaaagtgacttttctgacttcttttattatcattgtgcaatttttagcaacaaaactcactatatctttgtcagttcttcagatgttacaatactgcctgctaatttgaaacagaaataacaatggtattttaaaaagtcattgatattactgatactttccattatcattatattttttactattattatgttctttttgccttgtccaccctagagaataggtacaaatgagtagtgagtatccacaaacttactaagatggagagaaggctagatggtgcatgaataatcagcatctcagcaacagagttgactggagccagtttctgacatcagagaatctctttgctgtaatcattttagccttatctcttatttataccatttttatgggaag

SEQ ID NO: 390784 - DNA, 665 bp, Homo sapiens
gtagataaatttgattatgccctgatattggatgatatcaagaaatgagtgatacttttattaggcatattcatggcattatagttatgtgagattgtgcccatcatttttagagatacatacaaaagaatgtaggaataaaagtgagttggatttgcttttttatattacaggaaaaaatttaaaaaaaggacaaattaattaattataaaaaacaaatttttgtaattgttgaatctgggtagtagctatgtgggtttaatggacaattcactctacttctttatgtttaaatatagtccaataaattttaaagtcatgagttatgtgaaatctctcaagttattcccaggtttgaaaggccgatgagccattattgtcttctgccatgaactcaggggtatactggactctaagaagtaatgggaactgaagtaattatatcctggcatttaaaaaaatatctcatgcatccttttcattgactttcaacagaagaatcctaggattataactcccttttgcccagtaagagtttaaatacaatatctgaatttgaattccaattctgtgtgaacttgtatgaacacttgcaagttttttttctttaagcttaggattcctataatgtgaagtgataaaataagtatggcatagggttgccg

SEQ ID NO: 390785 - DNA, 504 bp, Homo sapiens
aatattctggccacactgttactcagtctttaaagaatatgttaaaaagagaaaaaactgaacagttcctaagtataatgttctagaactcacatttaattttagttagtatacaatatcacagcaaaaaatatgtatgcatggtcatatttttttcttcatgtactcttcacaaccatcatcaatttggaatatggtctgagacaggacaggatttccaaaacatttgaatagttcaccatattcaaagttgaataatttaaacaattaatttaaaaactattatgaggtttatttggtaaagtttgtgttaaaatatttcaaaacacgaaaatgttaagagttttggaactcttttacataaaaatttaccttaaataggtaaatagatactgaaattatagcctttaagtgcttttcttacttctgaatcacttattcacttatttcttaattttatttataccctcagtgaacactagctattcagaagaaaattctcaa

SEQ ID NO: 390786 - DNA, 198 bp, Homo sapiens
tcaaatggtgctttctaaaaacagaacagattgcttcagaaggactgaacctccaactctgaaggtcttcacttagaggaggagggctctgtgtttaatgatggtgaggtagggactgagcatcaggagtgtgatttaaggatgtggccccagggactctttcgttgctgaaacctaccatgctatgaaataccattg

SEQ ID NO: 390787 - DNA, 302 bp, Homo sapiens
gccactgttccagtagttcaacaagtcttagaactgagtccaactgtctttctgattggtcttttctgggtaacatgcacagccctgaaccaatcgctgtggcaggcaaatgcgacgctctgattggccatcttggatcaaatgccctccccctgagggagattgggtgcagcttgcacctgctcaggtacagagactgagaatgagggaaagattgcaggtttccagggaaatgcgggtaccgtttgtgaatggtgggtaggcaaaagccaaggatgtccaatatagtaggtttttaatca

SEQ ID NO: 390788 - DNA, 624 bp, Homo sapiens
ctgaagtggggccaatgagttgaacctttgttgttcagaaacaacttctgatatttatgtttatggcagaaagctgcacatttatgagcaaatgaatgagtttacagcgagcgtgcggcagcctggaaataactgctgaatgattttaccatctcgagcactgtgcacactgtgatgtcggggcagagcagggtgaggactagagggtatcaaacgtatatgggcaggtactaattatcccgtgaggcatgatactaactgcatctaaaattgcatcacctcactgcagtagccactgataatccagcaaatgcttaaacatcgggcagaagaaacatttatatcaaactggctttctcaatatgactacctggttttattctgctgagctcaaactttacatgtactttagaaaaatggaataaccacatgtagatactgcagagatcaacttggctagtggactctgatgctgaaaaaaacaacacactggaccaggtttgaatctgagttcagctactcaccaaccataacctctctgatctttcaactactacctttataattcatcaataaagggagtcaatgtcagtagcactgatttcactggatttaaaaaaaaaa

SEQ ID NO: 390789 - DNA, 725 bp, Homo sapiens
actccaatatctgatttccccaatttccttcaaattttagggtcttaaggtataagttatacataatgccaaactattgcattttacacagtgagaatttatccttaaatattgttggactaggataccccattctccatgatgtgcttatttcgtattgcatgcctgtatcaaaacatctcatgtaccccataaatatgtaactactatgtacccacaaaaatttaaaaaataaaatgttgttgtactattttaaggtttttttcatctttaaggttcttttcctgaagagaattcccatcagcaacagattatctctttaaagcatttttacatgttatatgttctaatatatacaattgtatagaaaagagcaaaatgaaccattacccatttcaatatttatcatgtgcagtcttgatttttcattttttcaatttttattttttaagagacagattctgtgttgcccagcttggtcttgaactccaggcctcaggcgatcctctcacctcagcctcccaagtagctggaattaccggtgtgagccattgtcgcctggctgcaatcttgttttttatacttaatccacatcccacctccccaacccagaatattttgaggctaattccatacatatttacatatatatacatctctcaaagaaaataacttattttccattcttcatatatctattcctataaataatgttcttgggggaa

SEQ ID NO: 390790 - DNA, 385 bp, Homo sapiens
aagcttcagcctcacacttgagatatagagaaaggagtcaggacgcattccttcgggtccaaagctttaactcttacttagactgccttagttttacctctccttgccttagaatctgaacaatatccaataaaaacattcgctctatgatgacacacatggggcaaagcctttggtagggttttcacacaagtctgagagtacatttacactcccaccatcaagaaggggagcctatggcctctccccataaacctggatgggccattgtgaccatcttggccaacaaatgaagcaaaaggaacaccgttgacttccaaggctggaacaaagaaggcaacatggcctccatcgggctctctctgaggactctcccctacagccc

SEQ ID NO: 390791 - DNA, 328 bp, Homo sapiens
tacaactagcacactaaactcattatttcaaatattgatcaggataaaaatatgttaacaaaaaagtcattaaaaataatgagcttcttgtgagtgatttacagatttgactaaaatgcaaactgtcaatgacaaatatgagaattaatatactccaaagggtaatgaaggaacagtcctcctgacatctttacatgccaggtagcaccctggccttttagagaggtagggatagcaattgtaaagcagcactgggtcccctagctagaatcgtccattactggcttttgtcactaactgaaaaatgcggtcatggtttccttttctc

SEQ ID NO: 390792 - DNA, 170 bp, Homo sapiens
aacaaacaaaaaaacttttatttaaccccagatataaaaattatttagctactttagattttttggtactaaatcttcacaatccactttgtattgtacactcacagcatattttatctcagctgggtctaaccacatttcaactgtgcaatagccacatgttaagacta

SEQ ID NO: 390793 - DNA, 196 bp, Homo sapiens
cccaacgctcacggcagcggtcgcctacttgctctagacgaaggtttggctccagacagaagcctgcccagtgaccacagtgttgtgaccttcctgctggccaggaaggccccaggggactctgtggcagtatagggccctatggaggaactttgtcctgctacagagctattgctcttggtaaacctagaagaca

SEQ ID NO: 390794 - DNA, 912 bp, Homo sapiens
atgttgcattatatattatattatatagtccagctaattgacatggcccagcagactgcccagggcatgaactacctccatgccaagaatatcatccaaggcgatctcaagtctaataacatttttcaacacaaagatgagtgactctcgtctggccacagtgaagacagagtgaagcagggcccagcccttggagaagccttcaggttctgttttgtggatcgcagctgacctgaaccccttcagcttccagtcggacgtctatgccagtgtggctgtgctctaaaatctcacgactggctcactgccttacagccacattggcagctgtgaccagattatctttatggtgggctgtgactcttcatccctggacctcagaaaaatctccagcaactgcccgaagccatgtggtgcctgctgtctgactgcctcatgttccagcaaaaggagtggctccatttgccccagactctcaccacaatttttctgctgcaagggtcgctccccaagatggaggggaatacctctaaatcgtccttttatcaaacccaagctgatgagtttccttcctgactactcaacacaggctgtcttgagcctgaccttactcccagccactagggagccaatctgagcccgccatgccaaggagccctgcccaccaacgaatcaatgttttatctctgtcctgaagttgcatcaggatctcatatcccccaccctgttagatgagggggtcctgatgtgctttcccagttcctctaaaattggaaaactcttaaagattgagcccctgcccccctccatcattttattttttggcttagaagatacctctaaattgggggaactccttcatctctcatggctaaaatttgtagcagggatttcactcagaacctctatggg

SEQ ID NO: 390795 - DNA, 160 bp, Homo sapiens
ctccttccccgtagggagctaggaaagaagggaaatgatactcactgaggtattggctcttctccattgggagggtgggggaaggctgtcgttctcagggaaagaagtattaggtgaacacacccggatcctaagggtgacccagcctaaaagctcaggg

SEQ ID NO: 390796 - DNA, 399 bp, Homo sapiens
gcactttggaaggctgaagtgggaggattgcttgaggccaggagttcaagaccagtctgggcaacagagggaaaccctgtttctaccaaaaaaaaagaaaaaatgctgggcatggtggtgcacacctgtagtcccatcccagatcttctgggaactgtgagtgcaccagaggcagctccttgggcacataagtgactcactgtctgggagggaacctgaaccacaggtgaagaccaactcccctgtcccctgccgtgtctggggacctgacactgggtttgtgtctgtgctctagccgtgccctgcaggggaaagggcaacgtctcgatctgaacagatattcctgttgggctctgaggtgtgcaggctggcaccagtcttgcccgacaggaatcgtgg

SEQ ID NO: 390797 - DNA, 391 bp, Homo sapiens
catcgggaacattcaaaatccatttctactaagtgggagagtgtaaaatcccagggagggtgggatcgactgtctcccactctgtttgaacttacttcccagcttcaccatttccacagcggtataatcctgcattgtggtggtctgccttctttcaggtggaggcaagtcttgtagggctaccctctgtgggtgtggttggtcttcttttatcttggtagtgaccatcagacatgctgagaggatgggaacctctatggactcatcccagtcctcatcctccctgccactagatctcttcacggggtcccaggacttagggttccaggacaatttagtcatgatagtcctaactccatgtggcagtcagtgacccttcaaacaggctatg

SEQ ID NO: 390798 - DNA, 377 bp, Homo sapiens
ctgtgatcttgttacaacttatcaagtggaggccacttacggtagccacttggtagacaaacactacagatcaccagatcttaaacaacgatgtaccaggacactttttttttgtctgcatgagtagaactaatttaaaatactgtatgtgtttttcctatttcaatgacttcagatggtctagtttcaatttcatgaaaaaatgaaaatcttaagtctaatatcaccactgtatacatgaatacttcctcaaactatgcaatatgcttacacatgtattccatcagctcatgcttcagactgtgctgttaggcaagcagggcaggcagtctgactatattttccagttgacataatgaaaaaatcagagaggggca

SEQ ID NO: 390799 - DNA, 753 bp, Homo sapiens
cagagaaacaagcaaatccctgcacttactttgtgctgtttgtgggatgtggctggcccattatcaccccagacttagtatggctaaaactaatctgtgcagtgattctctccagccatttaaatcaaggtatatatagaattgctctaatcggaaatagagcacagtgatcattttaaaaaggtttcgattctgaaatgaatggatacttttttggtctaaaggtgctaactcagctccttcactgaggtccctggttcttagctcagtgtggttgaggtaagtgttgatgttatcctgtcacttactagtaggagccagggtgctctatttgcatcccagctctacctcttactggatttggggaaagttgcttgacctccacgaacttcagcatccttgtatgtaaaagcaagaaaataaagttcatttagcaaatatttcataagatcccataggctctaggcattctaggagcaagtgtacaaagtggaataaggaaaaaaccctgccatcagggagccacagtattggaggagggaggcagacaggcaggcatcagcgggttggtaagcacaggagagtaagagttaaatcaagtcactgctattattgattatcggagtgctcaataaatattagctatcccaggaacccaaaaaggagaaaatagggactcaactgagaaagaagacaattgggaaatggaaagaattagggaaacatttcatacattacaaagtcttgagtgag

SEQ ID NO: 390800 - DNA, 415 bp, Homo sapiens
acaacaaattatttagcattcctattttaatgcccaatcactgttttaagccatccatgtccatatatattaactaatctaatccctaataactgcccccatgcggtagttactaagattataccaattttacagatgagaaaactgatgtgcagagtaggcaacatggccacatcacaatctggagaacgacaaagttggatttagaatcccaggtatatgggctccagcatcttaagtcttaacctgggcactagactgcttctccacaagatcatggctgatttattaacagcaacagttatggaagactatcctgaccattttcactacttgattgggcagaaacgcatagaaagcataaatgaagatttaaaaatcataatctctttgaggacttcagggctaaaaaaaa

SEQ ID NO: 390801 - DNA, 344 bp, Homo sapiens
cccagaatgtgatctgtcttggtgaatgctccatgtgattttgagaagaattgtaatctgctgcctgctgctggatgaaatattctgtagatgtcaattatatacagttgattgatagtgttgttgaattcaactgtgtccttactggttttctgcctgctgactgtgtccatttctgttagaggagtgttaaagtctccaactataatagtagattcacccaggtcttcttgcagttttatcagtttttcccttacatatttggatgccctgctgttaggtgaatacacattaagaattattgtgtcagcggggtgcagcggctcatgcctgtaatcccagca

SEQ ID NO: 390802 - DNA, 877 bp, Homo sapiens
catggtgatggaaggtcccagatatctgagtccaaactgtcctgaccttttaagtgaaaaccctttacatgccttgttgccacataaaataaaaagagagaaaaagaccagtgctgttcatggtcaaagtcagagtggaacctgcaattctccagatctaatgtgtttcatgacccttgtcattggtcatactgggatctgcatacctccatgtgcccctggaagagcagaactgtttgccaaatatctaatacaggaggcctgcaatctgggtctggaagctgtaaggcctgggttttgttacttggccaagttattccaggtttttggtctactcattcataatttttggtgtcgagcatccgaaccgggagcacctgaactatctcgggctgtgcaagtgtggcctgggaaacagctgaaacatttggtaatttggcaaatatttatgcttaaaaggcagtgctggaaccaattatgacttccttgaggggtttgagaatgctacctatggaatccgactacagggtttgagtgtaacattgccttggtatatctaggaagggtccaggaccatttctgttttcaatgcaaaggggaaaattcctttccaatgacttcaactgaattgtttgacatttcccagcccagactccagacctggtgatcagatgatcccagccccagccttcaaaccactgcaaatagagaagagacaagctatccctgagagagccctgcccaatctacagattaataaagaaaataaatactgttattatttttaaaaacagccctgtttggggtggcttgttatgcagcaataggtaacacgaacaaacggtaaagcttggagcctctgaatgcccggagtaaa

SEQ ID NO: 390803 - DNA, 413 bp, Homo sapiens
tgctccgtgtaatttaagagccttctcaccttcacagtctatgattctgagcgcagaatagcagtatgaagccaacgagagtgcaaattcaggaaagtatctggggctccagctcattttttagcacaaaccattacttctaccttatctatgcacacctgaaagctcctgtaagggctccacttggtctgggggcaaggttctcattggggtcttctataacttatgtctgttattgggccagactgtcagtacccactctctgcatacgttcttaccgcctctcacccctttatcctctccactttttagggttcccaccttcaggtgcatgggcttccatagatgtgagtctccacttgccagtgattctcctctctcctggtggagtcatttttcttaactaagatagg

SEQ ID NO: 390804 - DNA, 452 bp, Homo sapiens
tgctccgtgtaatttaagagccttctcaccttcacagtctatgattctgagcgcagaatagcagtatgaagccaacgagagtgcaaattcaggaaagtatctggggctccagctcattttttagcacaaaccattacttctaccttatctatgcacacctgaaagctcctgtaagggctccacttggtctgggggcaaggttctcattggggtcttctataacttatgtctgttattgggccagactgtcagtacccactctctgcatacgttcttaccgcctctcacccctttatcctctccactttttagtgggatagagcagggagggaaatgaatttttaaaaaatatttagtgggacagttcttctaagctcttccttgagcccgaaacattcataactctgagatcctgtgtttcaagagagtggaaaatgaccctaaggtgtagg

SEQ ID NO: 390805 - DNA, 180 bp, Homo sapiens
gcagacagtggggaagaatgccccagagccaggtaccacactgaggggacccagacactggctcagcctcccctttccttcagctgctgaacgcctgagatgagttaaagtctaatacttgggtccttctcttattttcccagcaactcacaagctccttgagagcaggaaacagcactg

SEQ ID NO: 390806 - DNA, 409 bp, Homo sapiens
aaataatgaaagaatagttgtattattctgggagtcggatagatcttcttaatttcggaaataacaggacaggcatggtggctcacacctgtagttccaacatttttggaggccaaggtggaaggatcacttgagcccagacttcaagaccagcctgagcaacatagggagctcctgcctctacaaattaaaaaaattagctgggcgtggtggtgcacgtctgtggtcccagctactggggaggctgagggaggaggatggattcagccagtgagatcaaggctgcagtgagctatgattgtgccaccgcactccagcctgggtaacagaacaagactctaacatccacacacacaaccacacacctacctaccttacaaagtatagatatattacttacataaaattt

SEQ ID NO: 390807 - DNA, 229 bp, Homo sapiens
gggctgaggatcccggcggctggggtctgtagatttaggaacaaacgttacgtataacttgatttgattatgaaatgatcacatacagcataataaaaagataataaaattctggataaagctggaaatgtttctgaaaaacatcttctgctatttcttaaaaaaatatctgaggaaaacaacccaaaaagccagaggagcgaggacacggtctttccactttcctttt

SEQ ID NO: 390808 - DNA, 479 bp, Homo sapiens
tgggcccacatggagggagtgacctggaatagctgggggccttctagacacaggtgggccacgtggggttcagagagcagcctcaggctcaggctggcaggatgggggcaggggagggagctctgaacgaggagggacctggggtgtcaggcctaagagcatgcaggtcacctggacagcagggcctctctcacctggccagcttctgcccccaggggactcttggccaaggctgggcatgcccttggttgtcacattgggagggagatggcatcggcacagcgtgggtggaggctgggtactgctcagcgccccgagaagagaatcacctggcccccacgaggatgacgcagccctcacgaggatgacccagccccatgaggatgacccagcccccacgaggatgacccagcccccacgaggatgacccagcccccattaggatgacccagcccgcgattaggatgacccatccccca

SEQ ID NO: 390809 - DNA, 351 bp, Homo sapiens
tcataggatattagcattcctttcccgctaccttttctttttcttctccacctttcgtgtcctgacagctctgcctttacatttatagcattataattggataagttaacttttgttctataactgttatgaacacttcagtgttttcctctgtaaattggattcacatgttaaaaaccaatgaaaatagttaggctcagtggctcacatctgtaatctgaacactttgggagacttaggaaggaggatcgcttgagccctggagtttggagctgtcataagctatgattgcaccactgcatttcagcttgggcagcaaagcaacaccctgcctaaataaataaataaggt

SEQ ID NO: 390810 - DNA, 801 bp, Homo sapiens
aactcggctaggtgttaagaggcaggcaggaagcaatggacagggagtccgagtgaggttgtgctctttcctgagagaggggttccgcaagggattggaggcgtccttgtagccaggtacagctttccccttagagatgagcgctcttggagaaatgagaatggggagaaatcgtccatgaacatggagattggacatccccacgaaggaaaggatgatttaggagacaagagggtcatcatgggaacaaaatttcccatggagttggggatcagagtaggattaggaaaagaagattcccgatgcggggagagccctgtggttagtaataagtgtgagggaaggatggcaccaccagaaacaaaatttccattgagcaaggggcttgaaatgggattagaaagacagaatatttctaggactgtcatgcagaggggtagtttaggagtcgacagtgtctcagcttcacagggaacaaaaccttctctgttgccaggaagaatggggttagaaaatgagagtcttcttgcaggatatacccatgaacggataatacagcctcctttgggcagggtgtgtggaagttcacaggctgcagggagcaggagagctcctttggctagtggccctgaaggggtagaggaattagtgggaaagcctgctttcgttatggaaccaagacaggaaatggaaaaagagtctacctgtgttttaatgaaacccaacacagagattaagcttcctgtggaggtggacattggactaacccaagccgaggggccagatgagactaagaataca

SEQ ID NO: 390811 - DNA, 292 bp, Homo sapiens
ctgtttggagtttaccatcatccacagcacactgtgggatgcagtgtctgttagttaccactaccttgggtacatgacagtcagccccaaccagactctgcttgtcattcaagaagtttacaaacatttgtcaggtgcaacaaatctttccagatacaaacttgaggtacttgtgactgttagtgcatctgtctctagcacgtggcgttgaaccaggtagttatcctctgttgctctctcttgttagcagaagcttgtcactgtactcaattggaaaacattttgttgaatt

SEQ ID NO: 390812 - DNA, 709 bp, Homo sapiens
cacaaataaaatcccaatgatttgggtgcatattgactcttggactgtttttaatggactttcaatttggtctagcaagtggactgtagataattggacaataaagatacccctgtctcagatattgctctttctataattctgagtgcaaatcaaagtaaatcatactgttgttcatcaaagaacttctagtttctcaaggtgattggaatcaacaagttgatgctttagttcaatctcttgaagtggcaatatgggtctatgaaatgagtggacattctggaggtcaagccatgcaatgatgggctgactggcaatgtatactactggactctgctgaagctcaaatttcttataaaaatagattattctgcttgccagcaggagaggcaacatttgaagtcatttctgagaagtaatcccagggaagaaagtctaacatataacagggaagtagattatattgcctcatttcctgttcattcaagggtatttgaatagaatatacaagcataatagatattcttgatttggctttgcatttcgatatctgaattcatggctgctaatactacccaaagattgaacaacagaaacaaaattatggcatgagttttgtcctcctagttaaattcctcatgtcaaggtgaagctttcagactgtgcaccaagattatgttgcaactgtgctcttgcattatctcctcag

SEQ ID NO: 390813 - DNA, 263 bp, Homo sapiens
gccagccttggccttccaaagtgctaggattacaggcatgagccactgcgcttggccaccatcgctatttattttgatgtccacattgtctctggtttgtgcagtgggcgcctcttcaagctggcctctgtgtcctcttgacacattcccaccatctttggagccctttcctgctttctagtggaacaagatctttctggctgatcttattcctgtctgctccaggcctaaaatcaaccctctctgattttagggtcctgatt

SEQ ID NO: 390814 - DNA, 355 bp, Homo sapiens
atggaatctttatctttgagtaaatggggctttctaaatagcaatatgaatactttttctgtttttgctggcataggtctttggggtctatgctgcttttcagtttgacttgtcaacaccttaaccaagtaaaactgactttgtggtttaagtgattgcgtgtgttttgggggcaggtgtcttaagctggttgaggtgtccactgtgcttcctgtcaggtttgtagctttcagatttgcaaggaggcagatcctctagttcaggcttgtccaacctgccttattttgttgtattgttttagacttgtagcagcctgaaaccatggtacttagtttctgtctctagtgataaatgg

SEQ ID NO: 390815 - DNA, 965 bp, Homo sapiens
gtcagcaggagtatctggagaatcacattcaaacccagtcgtctgccctggatcgtgttaatgccatgaactcagccttggcgtcagattccatgggggggcagaaaaccctcgtggatgtgactttggaaaacagcaacatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgacttta

SEQ ID NO: 390816 - DNA, 1827 bp, Homo sapiens
cggcgccggggcggcagcagaagtccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgacttta

SEQ ID NO: 390817 - DNA, 137 bp, Homo sapiens
tttcctacctggtttatgtgacttcaaattcagcagcatccttttctgtcatttccagagactcaggctgacactctttcctgtggcctttgctttatgcatttctaccaccccggcccagattgcttgccttctcc

SEQ ID NO: 390818 - DNA, 419 bp, Homo sapiens
atcaccctgtagtgtgtgtttgcagctaggatgtccatccccggccgggaggtgtggctgctgcccctgggtttattatctgggtcagcagagcctggcccacagggtgctgttgtttctgggttccttgtccccagttgcatccatccgtgcacccttgtttggtggtatttgtatctggctgtccccttcccaaggctggtggtgtggcccctgccccacccctgctgttcccatcaagtgttctgcgtggccttcagagtcctgatgcacgttactgcatctggggatggtgtgagccctgcctgcaagcaagcagggaaacagatgccacttcttatggccattaatgagagccagggagcctgcctccctgagggtcttgattcctgttgagtatttgatggtgaatatgaagc

SEQ ID NO: 390819 - DNA, 437 bp, Homo sapiens
gatgaaaagcccccgatacaccataaagatgtcctgctttcccaggttctctcaagttaagtatcagtaaagaagtgatctctttaaagccctgaagtaacacagggctaagtctcttgggtatactctgtcacatcttacggacttttaacgtgtatcgttctacagtaaacagtatcgttctacagtgaacagtatgctcatttcattagcatttgaaaatttgactgataatttttagctatataattgttcagtctggcatgtagcaaactgtcatcttgtttatttatttattatttattttttgaaatggagtctccctctgtcacccaggctggaatgcagtggcgcgatcttggctcactgcaacctccgcctcctgggttcaagcaattcccctgcctcagcctcccaagtagctgggactataggca

SEQ ID NO: 390820 - DNA, 433 bp, Homo sapiens
tgtgcaaacctgaaaactgtaaatgccaaaatactttgtaaatattcagatttttaaaatctttcctattacctggtgtggaattatgtacatatttggatggtcttcttgtgttatgccattttttgaaaagacagaatatagacatgtaaaatataattttcagatgcttgtacttaaacattcacataacattttagtgaatttctaaaaatcaaggaaataatcatctcagcttcaggcacaatgctaacttagatgagtcataggtacgtcagaaattaatgataaggaaacaatgtcaggggaagttaggtaacttgcctaaggtcacagagactatagaaaaataataattaaaatgcttctcctaactccaaccaagttcgcacgccttccattttagcataaggtttatgtgttgagcccttct

SEQ ID NO: 390821 - DNA, 508 bp, Homo sapiens
ggagaacggaatccagatttcagctggaaagctcggtaaagttacctttgtattttgtccctgaatgtcttcatctatagctgttactagtagactaagtaggtgctgtttcaggtggctgtctagtgtggaatagctataattctccaaagtttaagttaatgatagatgtttgcttttcagacaaactaattcaaggacagagattatagttgtagggtttggtatattttttaaataacagagcgccatccttaaagcagtgattcttagggagaggcatacaaccccaaccctcaagaatatcagaacttcctgggggtgtatgcgatgaaaaaaaaagcaaatatttaagttcataattctgttttgttttgtaacagagtttcgctcttactgcccaggctggagtacaatggcgtgatcttggctcaccacaaacctccacctcccaggttcaagcaattctcctgcctcagcctcccaagcagctgggattacaggcgca

SEQ ID NO: 390822 - DNA, 504 bp, Homo sapiens
atgaaagcattctgaaatagtctggggaatatggccaaggcaatgtctaatatatgttgcttataaaggagaacaaaaaaaccttagcttgcttctctcccacacccaccctgagtagaataccaagcgcctgaaccagagagagtgcacctaaaataaagatttccctcacccttcaccaaacacacacattcatgcacatgtgcacactcacacacactaaaaggagagcccaggtttctgggctctgacaatgtatcaaactcagatgtatgaaggcagagatgtgaggatccaagcagcatccctgttaccaacctcaagagtaggacactttaaacatcccagttagggcatagacttgggaacactgggttttttgtttgtttttgcaaaggtctcctgagtttccttcaagggatatgggcccctttggcagcagggaggtatactacaatacaggggacctatctgtgatcctcactttttcaccttcttcactgt

SEQ ID NO: 390823 - DNA, 374 bp, Homo sapiens
aactttgctctgttagggctttcccagcttttcacttctagtgttttggcgtagagctctctggtgaggctgttcaaatatcacaagctgtcagtgtcttcgagctgatcttcattgtactctgactgatgtcacgtgcccagtaggttgttttgtttccttaaggcattgcagctttcagcttgggggtggaaatgcctccataggactgaaccttaaaccttacggtcaaaagtcattgcctccaaatttaccatcctttgacctagggcagcactgagcaactggttagccgcctttctcagtctggtactgctgtgtgcttattgttttcagagtgtgtacttctcagttaatggaggcatcccaggtca

SEQ ID NO: 390824 - DNA, 242 bp, Homo sapiens
aactcttactgagaataatagtgaaaatattttgaaaatattgaatattttagcagcaagaatatgtgcacatgtgcctgtagttattcatttccaagtaaactgagaactgatctcatcacatcagacactattctaacaaaaagcaatccaataactgcaaagtgtcatgagacttctttccattaattgatgtgagattcaagaacagaatccagctgatagatatagtttggatgtgt

SEQ ID NO: 390825 - DNA, 388 bp, Homo sapiens
tagtattgtttcttaattgtacagttttcttatgagtgaagatacttggtaggtgtacgtgatttcactgaaagcaaagggattttcatcttcctttgaccctttaacaacaacaacaaaaagggctgagccaggcagggcacgatggctcacacctgtcatcctagcactttgggaggccaaagcgagtggatcacttgaggtcaggagttcgagaccagcctggccaacatggtgagagaacaaccccctctctactgaaaatacaaaaattagcctggcttggtgttgggcgcctgtaatcccagctattcaggcggctgaggcaggagaatcgcttgaatccgggaggcagaggttgcagtgagccgagatcacgccactgcac

SEQ ID NO: 390826 - DNA, 345 bp, Homo sapiens
aaggtcccagaaatccctgccggtcacctgctgccgcttgccagttcttctgtggtgattctttggaagaagcccagtactgaatcacggaatagggcaagcagagggttctcttggaacataagaaacacatgaaaataaagactgttttgttctgtttcctagtttgcacacaaatatgtctgtattttactcataattggcctgaagatacattgtactagaaaaatcaaatggcttatttcaccaggcttttctcccattctgaaagtgctgaagcccttttactcatggctgactttcccccccccacccattaatggttaatttctgtgcccagttctt

SEQ ID NO: 390827 - DNA, 846 bp, Homo sapiens
ggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctcctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattcc

SEQ ID NO: 390828 - DNA, 173 bp, Homo sapiens
tcctccatgagtcctgagtcttttgtgagtgatgtggttcgtgtgcacctgtgtgcatgtgtgtgtgcgagggggcacaggagtctcgtctcgtctccgtgctgtgtgggcagatgaaggttggcctgtttttactctctctgtgtttctccttgtcttttttttattccctc

SEQ ID NO: 390829 - DNA, 539 bp, Homo sapiens
ctatgtaatctcaatagatgacagaaaaaatattcaaaagaatccactactctttattgataaaaacaataaatactcaacaatctagaaatatagaactttcttgatctcgtaagaaacttgtgaagcactccacagctaatgtcatactcaacagagaaagactaaatgctttcccttaagaccaaaacaagacaagagtatgtactgttactatttcttttcaacattgtactggatgttctacccagagtgattaggttagaaaaaagaaataaagccatctgaaatagaaataatgtgacatttttaaagtcatatcaaagtttctaaggaattcattaaaaaggaagcataaacaagttcatcaatgcagcaggatacaagaccattatacaaagatcaattgtatttctataccctggcaatgaacaatgcaggaaatcaattacatttataatagtaccaaaaataataaaacacctagaaataaatttaattaaaaagtgcaaggcttgtacactgaaaaccatgaaatg

SEQ ID NO: 390830 - DNA, 141 bp, Homo sapiens
ttttacccagttttgaattgggttaattccttttttttgctaagaaacctgacccatttgttttctaaacatataatgtgtataaaaaggaattaacccaattcaaaactgggtaaaagattttaataggaatctccatat

SEQ ID NO: 390831 - DNA, 543 bp, Homo sapiens
agtatcaattatcattgactatttcttcacctgaagaagtagaaatagtagtttgaaattaatattcatactctcaaacaccttctgtagactaagggtcatgaattcaaggcagtaaagatgaacagaaaatagtctcaatgttggaggaaaagggagcatgggatccatggagcatggcccatctaaaacagcagcatctcagctcaagttgactgtcatcatgttgaatgtgttgacaaggccaggtgcagtggctcacacttgtaatcccaaaactgggaggccaacgtgagaggatggcttgagcccaacagtttgaaatcagcctaggtaactaggcaagacctcatgtctatagaaaaataaaaattaaaaatgagccagtgtggtggcacatgcctgtggtcccagctactcagaaggcagagatgaaatgattatttgagctcaggaggtgaaggctgcagtgagctgtgatgattgaggccactgcactctagcctgggcaacacagcaacacaccgtgtctcaaaaaaaaaa

SEQ ID NO: 390832 - DNA, 211 bp, Homo sapiens
ctgaactaatttgttcttattttttgccactgcaaacatatatctacagagagaaaaattaatggcattttaaaggttaaaacattttgaaaaattattagcatgtaacaaagaatgcttgcatttgattagtttcaccagcatttgagagaaggaccctttagctctgtttgttgttcaagaacataagcaaccagtagctcaaatgtag

SEQ ID NO: 390833 - DNA, 331 bp, Homo sapiens
tggacacactatggatttcttatcctggctcttttctgctgctttagagacttagcttctctgtaggccaagtgggcactaggagttgcggggggtgtagtacctgctgatgggacttctgaaggtaggctttccctctgaggaacgcgtaggcctacatctgtttgaaatgctgggttggtaatgtcagagcctcatattagcacagctccatcttcttgggtccaggcggatctcactcacctacactagttctctgggggagcttttacacaagtgcccccatccccctctcttgaatatggagtttcacaattaccattttagtcta

SEQ ID NO: 390834 - DNA, 219 bp, Homo sapiens
cagatagagaggtctttctaaaaatgtaaatcagttttgtcattctgctaggaactcttctgtagtttctggctgcacttcaaaaacatcccatcttacctccaagtctgcaagttccttgagccctgcctacttttctgatttcctctcatacaactctccttcagacttattactacttaacccttccattttttttttaagataacaagccattct

SEQ ID NO: 390835 - DNA, 316 bp, Homo sapiens
aggacaaggctccatagctgtatctccagcatctaatgcctgtctggcacgtagtaatgctcagtaaacacttgttgaatgaaaaattaatttatattagaaatggaggaagggcttccagatgctaaaagacactttccttttagcaactatccctccctggatcccagaccccggccccaaaatgtcctagatctgccttcccaagctggagtggctgcagcttttttggctgctccctcctgttttctggtccctatcttcctacacacccttatcttcagcctgggaagaacctcaaagcatgagcaaaact

SEQ ID NO: 390836 - DNA, 806 bp, Homo sapiens
agtggtgttaaaagtaagacattttagttctctgacaatctcatgggctcagtaagatgaaattcaagtgggatcatgtatgtacccagctcttggtagattctagagggaagaccagaagcatctgtggttctgtctgtccttgtctttcttggatggcttggctctgttaatctgccttcccggtccttgtttgaatgtaagctgaaagctcattccgtctgcttctctctgtgcttttgctttctgccggcaggacaagcaccttaatcctctagacctgcctgtcactgtaagtagcactgccatgtggaaagggccccagctcttgcaggtggggaagtcaaagctaggcaagaatctcatggtctgatctagatgttcagggcatgccaagacccagggaaaggttgtgtgctgtgaatctcctttgtcaggacacttagggaagtactgcagattagagtcacagaaaggattaagggggtacctgccccagggagtgtggccccagccttcctttataacttgcctttgcatgggtctgtagttcaactagggcagaccagactcagaaacagctcgtaactttgatctagacaataccatggatgcgtcaccttcttacttgctttagtggaagagaaaaggtatccgtgccctttttggactcttactagaccgtgggaatccgaaaaggtttagacaatcgacaaaagggaatttggatgctcatttcttcattatagggagctttagagaggtcagctttgcgaggagatgaaaggggataagtgcctccccct

SEQ ID NO: 390837 - DNA, 273 bp, Homo sapiens
atctgagatgctctatgacctggtctctatttatctactagcctcatctctagctatttagtccaatattttatgttaaaattatgtaactgtttatcattcctgcacatatcatggatctatgccttgtttcttacggtttctatctagaacacctttctaatcgtcttttacctagttagcagccacttgagtcactgagatgacacctctgatgaggcatcatctccaggaattcattcctggagttccaggttgagtcaagtggccttc

SEQ ID NO: 390838 - DNA, 435 bp, Homo sapiens
taagtaggttgggctggggatcggttccttgatttcatgggtatcaaaagatcttggggggctaatatagatcattcccagagtagggaagccttccagacgcctccttgggaagatacataagcatttatgagcacaggcccttcctctgtgctgtgcccatgatagggatgtgtgtgtactctgaattctttcacccttgggaggctggtgtccctgttcacgctgtgggtcaggacaccgggatgcagggggtcaggtgcctggcaggtcgagtgggcggagagcaattggagctcaggtctatctgtgactttcggggctttgctgcccatggtgggacagaagggctgttccagcaggatgttcctggacatagaggattcattggctctgctcaatggttcctcctcactaccagtcacggggcttctg

SEQ ID NO: 390839 - DNA, 486 bp, Homo sapiens
tccagtaaggtgtgccacagtacagaaattgcatagaagaagagcagagcaaggacaaaggagccctgggccacaccatatttctgtcctgactgtagctgttttgctaaggagcccgtactagccttggaggaacagctttcgatgctgcaaggaaagcacagagtggggatagctgatgggagttgtttcagtggtttaggctgacttggtgattctaggtatgccttaggccagtggctgctgcttcttctgtacatgaatgtcatgaatgtctgagtagggagtgagaggttcatgtaaaccttttatgttgtaggcccagctgtgtggccatgggagggtgcttggcatgattaggatggaaaacttttttgcctacactgatcatgccagagcgatttaatatttcaataagaatttaagggatagactcatcttggagtcgtcgtcttggcctgttttctcaccagtgttttgggtgtt

SEQ ID NO: 390840 - DNA, 1925 bp, Homo sapiens
  misc_feature (2)..(2): n is a, c, g, or t
  misc_feature (696)..(696): n is a, c, g, or t
  misc_feature (848)..(848): n is a, c, g, or t
cntttctctcctccgcgccgccgccgccggtgcgcaggccggctggggactcgcctccgctcgggccttcggtttcgctccctcgctgagtcccttctccccgccaacaaaaggtgatgattcctagcggactgggcacgcctggacggcggagggtggctgggaggggcgaggtcacgctagcaacctgtggctgccaggagaaggcggctgggaagccacggaaagacccgggagcgcaggggaggtggctcagctcgcgcgcagcccctgctcttattttactattatgcgtgttgctgttcgtatccttctgggcggtgaaggggagaggcagcctcccgctccggtgaaacccgtcctgggagtcgcccataaaccctgttctccatctcgggcggctggaggggtgaggggggtgcggcgccttggtgggattggcaggtggtgacttccagggcgcagaggagaaaaatctctgctcttgggcgccaggatcaaggatacccaaacccgcggtggctctgccgcctgttcctctctcttggggtgctggggcacctgggccgcatcccttgtgaagtgtagagcagcagagaggcccggccgccggcccagcggccctcccaaacttccgaaatgccgacgggttggacgggtttccgagagctggcgagttgagaaggacaggaggtntggggtgggggaggggcctggaccgttggagtgggtcctggagaccctaagtggcctatgacaagatttggaaaggtccctggttgacgctagggagctggtggggatcctagcagcgcattttgtctgtgggccctgggccagactctagnctccctgagtgcccagatgggggtctgagattacctattggaccctctcttggcaaagacaaccatagtgtgatagtttgcttttttctcccaaatatgtgtgagttcagcctgtctgggagaatgttgatgttagaaatcaggcccagaggccaacattggcaattcctagatttaagattaaaagaaaatcagagggtctctggacctagttgtgggcaggtgggaactctcctcctacccacctgcaaggtcccaggactgggcataggcagagatctctggagtgttgcagttagagggttgtttttgtgttgttcctgtatttgttaatgaaattgatattattttgacttcctcactaaagatgcaagtatttctcagacctagggagttgagtagggagtctgggtggggtggaggctttttctatgcacattttcccttactctgtcacagctttcacagtctcagttccctccagcccaatccccagactctcagcttagtaaattcacggcttctgggagcttcagaaagttggttcgtaaaccccagatgcccattttggccctaccaccagcaacccaagcaggtggctaggcgagttcatatgtgtttagaaggaaaggacccgtctggggctaggaaggtggggaaatggggttcctccccacacctccccgggatagaccctctctcctggctcccaggatgtgtgagaggctgggaggggccctatatcatctggctgcatcttttatggttcctcattgcccttcattcggaaatgaaacgcctttgatcttttctcaggttgtaaacggaattgcccgtcattaaatatctggggccccatctgcttggtctcccagcatttttctttacagctgtttctctctctttttaccactgaatttttccaaaaggacttttattacaccaccttcacacccagccgcctcttcctcctcccttcgctgagaggcgctttggaaaatatctagatattcgtttgatcacaaactaaaggcttggaggggcacggaggagccgattggggttttgttttttcta

SEQ ID NO: 390841 - DNA, 1723 bp, Homo sapiens
  misc_feature (2)..(2): n is a, c, g, or t
  misc_feature (696)..(696): n is a, c, g, or t
  misc_feature (848)..(848): n is a, c, g, or t
cntttctctcctccgcgccgccgccgccggtgcgcaggccggctggggactcgcctccgctcgggccttcggtttcgctccctcgctgagtcccttctccccgccaacaaaaggtgatgattcctagcggactgggcacgcctggacggcggagggtggctgggaggggcgaggtcacgctagcaacctgtggctgccaggagaaggcggctgggaagccacggaaagacccgggagcgcaggggaggtggctcagctcgcgcgcagcccctgctcttattttactattatgcgtgttgctgttcgtatccttctgggcggtgaaggggagaggcagcctcccgctccggtgaaacccgtcctgggagtcgcccataaaccctgttctccatctcgggcggctggaggggtgaggggggtgcggcgccttggtgggattggcaggtggtgacttccagggcgcagaggagaaaaatctctgctcttgggcgccaggatcaaggatacccaaacccgcggtggctctgccgcctgttcctctctcttggggtgctggggcacctgggccgcatcccttgtgaagtgtagagcagcagagaggcccggccgccggcccagcggccctcccaaacttccgaaatgccgacgggttggacgggtttccgagagctggcgagttgagaaggacaggaggtntggggtgggggaggggcctggaccgttggagtgggtcctggagaccctaagtggcctatgacaagatttggaaaggtccctggttgacgctagggagctggtggggatcctagcagcgcattttgtctgtgggccctgggccagactctagnctccctgagtgcccagatgggggtctgagattacctattggaccctctcttggcaaagacaaccatagtgtgatagtttgcttttttctcccaaatatgtgtgagttcagcctgtctgggagaatgttgatgttagaaatcaggcccagaggccaacattggcaattcctagatttaagattaaaagaaaatcagagggtctctggacctagttgtgggcaggtgggaactctcctcctacccacctgcaaggtcccaggactgggcataggcagagatctctggagtgttgcagttagagggttgtttttgtgttgttcctgtatttgttaatgaaattgatattattttgacttcctcactaaagatgcaagtatttctcagacctagggagttgagtagggagtctgggtggggtggaggctttttctatgcacattttcccttactctgtcacagctttcacagtctcagttccctccagcccaatccccagactctcagcttagtaaattcacggcttctgggagcttcagaaagttggttcgtaaaccccagatgcccattttggccctaccaccagcaacccaagcaggtggctaggcgagttcatatgtgtttagaaggaaaggacccgtctggggctaggaaggtggggaaatggggttcctccccacacctccccgggatagaccctctctcctggctcccaggatgtgtgagaggctgggaggggccctatatcatctggctgcatcttttatggttcctcattgcccttcattcggaaatgaaacgcctttgatcttttctcaggttgtaaagaaaaatgctgggagaccaagcagatggggccccagatatttaatgacggg

SEQ ID NO: 390842 - DNA, 287 bp, Homo sapiens
cactccatacatgacagagctttgtgtggctggttggagaagatgaagtcagagaaggtgggagcttgagaaggactccataagttgttattggttgaaagatgaaacagacaggtaaggaggaaagcacgtggcctctggagtcagagtagactgtctccccgctgacagccagcacagaaaaagggccctcagtcccccacaaacaagaataggaactctttcattatctgtagtgaacctggaaaaatagcttgagctctaggaaaaaaacacagccagcccat

SEQ ID NO: 390843 - DNA, 306 bp, Homo sapiens
catgacatcttttagtaaggaaatagactctacaaataaagttgtgtaaaacagaaagttaggtctttgaaatccttaccactgccaatgggccttgcatttaacaaatagaatataaaactacagactaagcatagctttaagaagcctgtaactaatagctacttggtacaagaatgtgaagtcagcccaggtgaggtggctcactcctgtaattccagtattttaggaagctgaggtggctgaatggcttgagctcaggagttcgagacaaggctgggcaacatggcaaaaccctgtctctat

SEQ ID NO: 390844 - DNA, 458 bp, Homo sapiens
aaaatcaataacgcacaatgcttttcccatcatttatggacactcacagaatagcaaaaaatttgagtcacctggtgcacacatctccagctgcagtcaagcaacgccacaccctgctttcttattctcttactataaacaagtgtcctttttgtggtctagttagtgccatgttttctatatttttgtgctttgtgattttgctgtttaaaatgtccccagtttggccaggcgtggtggctctcacctgtaatcccagcactttgggaggccgaagcaggtggatcacctgagatcaggagttcgagaccagcctggccaacatggtgaaaccctgggtctactaaaaatacaaaattagccgggcgtggtggtgcatgcctttagttccagatacttgggaggtggaggcaggagattcgcttgaacctgggaggtggaggttgcagtgagcaaag

SEQ ID NO: 390845 - DNA, 320 bp, Homo sapiens
agggatgtccaatgtacgcagctccttcctgcgctgcatccaaccccgagcggagcagtggaggaagcctctgaacggaacctcgcaggcagctctgctcagagcccctcacgggcaaacacgccaacacccgcaacccggcctgtctcagggagggccctgctcacagcagcagagccacagaacctgtgaagggacaatggacactgagctggggacactggccacttctaggggacactcaggctcacaggaggccatgctgtgcttcttctccttccctccctccctttctttccttctctctcccatcccctttt

SEQ ID NO: 390846 - DNA, 703 bp, Homo sapiens
agaatatggaatacatctcaattaattttaaggtaatatataagctaacaaaaccaataaagacgtaatacatcatgacctgatagttattcaaggatgaaatattggttaataagaaaatcaatcgatgtaagatgccacagtagcagactgaaataggaaaatattaaggttatcacaataaatgcaggaaaaaattgacatgttttaatgctactttataataaatatttttgctaatttgaaatagaagacttcttcaagctgagaaggtcatctataattaaaaaaaaaaaaaacaaaaaccttacaattaatgccaggcttaatggtgtaacattaagcgcttctcatgtaagagaatgaacaaatcaagagtttcttatatcatttctgttcatcatttccttaatggccttagccagtgctataatgcaagaaaaataaataaaagatacaaataaggaaaaaagtaaaactcaatattcacaaacaacatgtgtgtaaaatacccttcagtatcagcaaaactaccaatagaactaatatgtttgtttagcaaggttataggatagagggccaaaggtaaatattaactacaattctacataaaagcaataaaaaactgaaacaaaaaattactatttacaatatcatgaaaaataaatagaaatgaatctaatgacatcatacaagactgttg

SEQ ID NO: 390847 - DNA, 322 bp, Homo sapiens
tcctcctgccttggcctcccgaattctgggattacaggcatgcgccaccacaccccgctaattttgtatttttaatagaggcagggtttctccatgttggtcaggctggtcaagatagaatagtacttttcaaaatgtggtttcttgaccagcagcagcagcagcagcgtctcctggaaatttattataaatgcagattttaaggccctggtcccatacctactgaattggaaactctagactggggtccagcaatctgtattttaacaagcatgccagatgattctgatgtacactcaaagtttgggaactgctgttaaga

SEQ ID NO: 390848 - DNA, 402 bp, Homo sapiens
ggtagaagaattcttgtgagagaaaataagaactctactgaggttaaggtcatgagatggagaaaaaggaactaattccagaattcgagactttgtgccttttgattatggatggtgaaagaaaggagggagttaagaaactttcaggtgaagtgagtgaagggattattaagcaagacaagcaatagagaaaaggaggcaggtaggagaagaagataatgatttcactgaggtgactgtgctacactctcatggtaatgtagaaaatataattctgacacatcagagggagctggaggccagaggcacccattgaggggtcaacatatggcaggtaatgggacaagactaggggcaagaccaaaacccataggaatcacatgagtgaggagaaatgatgag

SEQ ID NO: 390849 - DNA, 248 bp, Homo sapiens
gagagaaacccttcagtgctctgggcctgggcttagtgtgctctccccctggggcagggatccatttggagcaaaaacctgtgcagccaacaggggaaggttcaacacatccacgtgggtccacccccaacccccagacccacggccttgaatgtttaaccccctccatctctccaggccttcgccccaggctgtgcagggtgaggagagcctgagcagagtaggcgtcacatcccagagtctgttgg

SEQ ID NO: 390850 - DNA, 273 bp, Homo sapiens
tcctgtctaacaaagatgataggatggcttccctttcagcctttgcgtgaacttaacttctggttggaaataagatcccattgtctaaattatgtcagcgtagttcctggtagcacaagaatattaaacactttaatgtgacatccaaaattaatgagtcagttataagaactttccttgaaggatggaaaagatcataacccattttcatgtcctgggatgcttcattcagtctcatggtattaaaaaatgaacagcctttggattgggggg

SEQ ID NO: 390851 - DNA, 572 bp, Homo sapiens
catttttactctgtagaaatattgtgatgattattacaaatgcagttccgttagaggagctgaaatttgtctttgtgattttatgccagctggtagccatgaaaattcatgggcgggtggaattgctttgatcagaagtcatctcttttttctgtctccatgccttcattatcagtctctccacattcttgtctccgtgtctctcctgtcctgtgatgttttgctcttcctatatccccatagttctttcatacattttcgtcattttctcaaactttttcaattgctttctccagcacatacctacttcctgcttgaccagcctaaagaaggctatgtctggataggatcaatcataaaaattatttaattctatgccctttactttacagatgaggaaactgaggcagagaggcgaagtagcttgcccaaataaagaaataaagaccaggagaccagacgcagtggcttactgctataattccaacattttgacaggcccaggagggaggatcacttgagctcaggggtttgagaccaacctgggcaacatagcgagaccccatttctaa

SEQ ID NO: 390852 - DNA, 517 bp, Homo sapiens
actgatgtcctctccctcagcttccaaatagactgaacttagcccatactttttttatcaatttaatttttttgagacagggtcacactctgtcacccaggctggagtgcagtggtgtgctcacactcactgcagcctcgacctcctgggctcaagcgatcttcctgcctcagcctcccaagtagctaggactatatgtttgtgccaccattgatacagtttgctgacagatttatctaagattgcgactcctttcccctacacttctattactactctgctttattttaatccttagtatttataatctaacatatgatatattttgcttatttatcttatttattacctgtttctctcactagatgcagcttcaggaaggcaggtgtttttgtcttgctgcgttccctgtacttagaatactgtctggcatcagttaatatttgttgaatgaatgttgattggaccggatgtggggtgtgagcgaaagagaggagtcaaagatgaagccaaaggc

SEQ ID NO: 390853 - DNA, 525 bp, Homo sapiens
accaaccggaatattgaactaggtacgagttatttggtaaaggaagatggaactgaattctctaaataaagcctggaatttcaattttttctcatcagttgaaaagaggactaaatgatgttaattcaccagcccagagaagtggccaaaacctgtctgtgctcaaagaccctaggtaggggaagatagtcacccatgtgaaagagaagtcacaagcttgtttcatgcacatgagtgggttcagaatttacaccgtatacttaattcagggaaccttagtcaagaaattgccatttagattgttttaggacagccatctcaatgaaaacataaaaaggaccatcatgaaagagaatcatcagaatgtaatggaaatcccattttatcaatgttcaatatgccatggagtttaaatttgataagccttgttttaaagctttgtaaagtacatgacagtacacgacaagcgctctaacagcaagagtgttaggatgcccaagaattagagttaatagaagaatctca

SEQ ID NO: 390854 - DNA, 342 bp, Homo sapiens
gaggctctctgggccatgcgtgaagggtgggatgatgctgttttagaaaaagagactacaagaccgggtgcggtggctcacacctgtaatcccagccctttgggagactgaggtgggcggatcacttgaggtcaggagttcgagaccagcctggacaacatggcgaaaccccgtctctattaaaaatacaaaaattagccaggcacggtggcacgtgcctgtaatcccagctactagggaggctgaggcaggagaatcggttgaacgtgggaggagttggttgcagtgagccgagatcacgccactgcactccagcctgggcaacagagcaagactctctca

SEQ ID NO: 390855 - DNA, 540 bp, Homo sapiens
gtgaacggagccttcccctgccctgccattttaaaacttcaacagaggttccagcaggacccctctagaatctggaggcacctctcttggtacagaaggttgagaaagtcaaatttagggattgttactgtgcaccttgtcacttttttccttctattctcccacttccaccttgggagacttgttaatatacataggactcatgctcctcaacgtaccatggggttatgtcccaaaaaacccatcatgagttgaaaatatggtaagtcagaaatgcatttaacatacctaacctaccaaacatcatagctcagcctcacctaccttaaacatgcacagaacccttacattagcctacagctgggcaaaatcatttaacacaaaacctattttatttttttaaaaaagtgttgactgtatcacataatatattgaatattgtactgaaagtgaaagaatggttgcatgggtacttgatgtacggtttctactgagtgcatattgcatttgcaccatcgtaaagacaaaaaataagtcaag

SEQ ID NO: 390856 - DNA, 711 bp, Homo sapiens
ccttcagctcgtacccacttcccaggttaaaataattctcatgcctcagcctcccaagtagctgggatcacaggcatgcacacacacccagctaatttttgtatttttagtagagacagggtttcaccatgttggccaggctgctctcaaactcctggcctcaagtgatctgccaagtgctgggattacaggcgtcagcccagccaatgtgtgtgtgtgtgtgtgtgtgtgtgtgtgtgtgtgtgtgtgtgtgttgggggagggggcctctcctgccctgcttatacctgactagctacctactgtaacaaggcacttggaaactggacgttgcactttcacttgcacatttgttcttaggttgaacccatagttctataatcttaaacatctagtaaagataacaaacttatttgactagtaaaagcaggtaaaataaaatgttatgctcgtattatacttaaagctggtaactcagaagacacagctgtttgtattaaaccaacaatattgagctagtcttatttacccaagatttacccaagttatgtgaactttaaaaacattttgggttagttccattgtctttaagagtttaagtaatacagtcttccttctgtcaaggttccatgaccccctgtggaaaccaaaatctgaagatgctcaagttccacagttggccttgtacatacaaaaagttagcccactgta

SEQ ID NO: 390857 - DNA, 527 bp, Homo sapiens
gaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctgaatcttctgctgctactgggtatttctacttgggtatcccaatgtgaccttgaactataaaactgaactcctcttcttcctgccttctttcttcctcagaactccttccgcaaaaccagctgtgatttttttttccttttttcttagattaggagcctcccagacatccttgactcctttctcttactttctcatgatgtgtagtccagtcaagcaccatgcattttcagttgttcttaaa

SEQ ID NO: 390858 - DNA, 723 bp, Homo sapiens
ggtgtgcgccaccatgcctggctaatttttgtttttttagtagagacagggtttcgccatgttggccagctggtctcgaactcctgacctcaggtgatctacccacctcagcctcccaaagtgctaggattacaggcgtgagccactgcgcccaggccttatggtctgttgagcagttcttctctaattaaatgttagccttgttagaaagggatagaagttagaaaatatatatttatatatacttgaaaaattttttttacagacagggtttctctctgttgtccaggctggagtgcagtggtgtgatcatggctcactgtaccttcagactcctgggctcaagcaatcctcttgctcagtccctgagtagttgggactacaggtatgtgccaccattcccagctaagtttatttatttatttatttattttttgagatggagtctcactctgttgccaaggctggagtgcagtggcatgatcttggctcactgcaatctctgcctcccaagttcaagcaattctctgcctcagcctcctgagtagctgggattacaggggcctgccaccacccccagctaattttttgtatttttagtagagacagggtttcaccatcttggccaggctggttttgaactcctgacatcgtgatccacccaccttggcctcccaaaatgctgggattacaggcgtgagccacagcgcctggcctaaattt

SEQ ID NO: 390859 - DNA, 329 bp, Homo sapiens
tagctgggactacaggggcgccagctaatttttttgtatttttagtagagacagggtttcaccatgttggccaggacggtctcgatttcctgacctcatgatccacccgcctcagcctctgaaagtgctgggattacaggtgtgagccatcgcacccggccccttttttctcactttcgttcctgaattgcattccaaagactgaacttgtcttcttttactgccctttttatccttgtataagaggtatctttgattcagttttcattagttttctaggctccatgcttctttggcataaaactcttctagctttgttccttgccctt

SEQ ID NO: 390860 - DNA, 465 bp, Homo sapiens
gtccctacctccccatgtcactgaagtgaactccagaatatggacctagataatttagagtccctggacatgaatgataggacaatatactctagggctctgattttccatatcaccttgacaaatctccttgacaaaacatgggcttgcctcaccttctcaaccatccccaccttctcaaatacacacactacatctatatctttactagtttcacaacagcatatctattgattaagatatatttggtaaagaaaaacactcattttgagaaagatgacttcagaccattctcttcctctctctgggccttctctttgtgggcatgatgggaaatgaactacagatactctgcaaggtccctttcatctctaatcttccagaattctatgactgtttctgaagagaggaagcagtttttagaagttctgttgcaacctgtagtgactctgtggtgactcagta

SEQ ID NO: 390861 - DNA, 261 bp, Homo sapiens
gcccccatgccagccaggtcccaggaggtggtaagtcaagatggacagcctcttgcaacacataggaagatccaagacctcggctgcctcactgtgtgacctcaagcaggccccccacctctcagcctccatttcaccaactataaagtgaggagactacttgatcgagtccttcccagctccaaagccctgaatctataaaaacagcacctaatggccaggcgtggtagctcatgcctgcaatcccagcactttgggagg

SEQ ID NO: 390862 - DNA, 354 bp, Homo sapiens
gagaaggaatagaaaatgcatatatttaactggtgccaggagagaggtttgtgtacagtacaggcatacctcagcgatactgtgggttcagttccagacaaccacaataaagtgactcacttggatttttttgtttctcggtgcatataaaagttgtggttacactataccgtagtctatttaaagtgtgtaatagcgttacatctacaaaaacaacgtacatactttaatttggttaaggtatggctaaaaatgctaacgatcatctgagccttcagcaagtcataatcttcttgctggtggagggtcttgcctccatgtctgatggctgctgactgatcagggtggtggttg

SEQ ID NO: 390863 - DNA, 454 bp, Homo sapiens
ggggcagaggtcacctgggatgggtcacctggaagatctagggcagcggtcctcaacagagggtgattttgttctccatgggacatttaacaatgtctgaagatattttggattgtcataaccaggggtgggggagctactgcatctagcagataaggccagacacgttgctgaacttcctacaatgcacagggaggcccctacaacaaaggattatccagcccaaaatgacaatagtggcaaggttgagaactctgatctagaggaaagctgaagtcacacaacatcctcaaagggcttcctagagccaggctctatgaaagaatcacagatgggaggacaaacgtccctgcctgccaggacctgccaccaaaacctgaacatgggacggcctgaaccttcacatttaggccaagagtcctcagcccttgggtcagaagatgtgtgtgccttc

SEQ ID NO: 390864 - DNA, 342 bp, Homo sapiens
aggcagaattgcagatttttaaaagcagactacatttcataaataaatttatgaaattaggtagaatataatctgaagagaactaattagaatattagtgaactaaagtacattcaatgtagcattaataatttcattttctaatttttcaaattgttatacattgctcgtttctcagactagatatacattcatgttgattaaagtttgtttaaaacaggcattaaacaatgtttaaaccattttaaagatcacaggctaggtgcggtggctcacgcctgtaatctcagcaccttgggaggccaaggcaggtggattgcttgaggtcagggcactgtttgg

SEQ ID NO: 390865 - DNA, 372 bp, Homo sapiens
ggcaaggcaaagtgccctaatgcgaagcggtgaaaacaagctactactcatgcatgcatgcacagtgccagggccgcgcctaatctgacgcagcagtcagacggcctaatgcccatttgctggatggtgaggctgaggtggagggaaggccaagccaccagcctcggaagcccagcgggaggtagcctcggagccctgcctctgcgcaccttctgcgctcgctgggagctgcctgacttctgcacgccgaggctgaggtcggggaggaaacagcaggaggacagctgccgcccccttgaaccccgtgctcacccgggagggaaaggtgggggccggtgctggttctggctgtccccctcccccacttcgagt

SEQ ID NO: 390866 - DNA, 555 bp, Homo sapiens
tcttgagtattcattgtacagccttttcagaaggaaaggagaaatgtggattaatctggagcatcggttaagagagctactactttaattacagaatttgttcaattacaggattaaagtacagaattagttccagcttttgaagtttttttgtatggtgttaattggaattttctagtttttgaggtagagttatggtagaatagagagaaaagcatttttaaatgtgatttttatgagaaaattatgtttccagaatttagggatatcattataaaaagatatacttccatgcttgttttttacttacgttttttaattcttgggctttagaggatgataatgatcaataaatggtagtcctaaacttgttaccatgttcttctaggatctttttgccttttcttttttttttttttttctttagatacttcttagaagttgaagtctttttgctgttttcacttaaacttctctcttgctggctgtttctaaagaactgactctaagggaaaatttctgaaattatgtgtcttcaggattgtatctcttttg

SEQ ID NO: 390867 - DNA, 349 bp, Homo sapiens
taaatcccttttaatctagattctccctctagctccttttattccacttgtgtgtgtgtgtgtgtgttttgtttttttgtttttagtggaaaacagacctttgtcatgcaaacttttccagtctaaatagtgactaaaatgattcctatgtattcatgaaacccagagctttggtcatatacaggttcagttttgtgtgtataggtgagagagaattagtcagactaattcacaaagaatgtggtggctttacaaacatgtgaaaatcttcaacacttcctccatcaagaggttgaagaaaagtggggctgggaatgggggattctgaggagaccagtcctttcccctt

SEQ ID NO: 390868 - DNA, 266 bp, Homo sapiens
aagtttctgtattgctttggaagtctctggttaaatgaatacccttttaatagtgacctgtgattctgttttgatcaagtgttttcaaacttgacatctttgatgggtttctccagtgtcaaaatcctaaatcaggtctttttggcttaaaattaactttgggatttttcagctgcgtcccttggggagtctaaagaatgtatctctcatcttgtagcggtattaagtgattcgatttatttggtagattttatgggcgggcattg

SEQ ID NO: 390869 - DNA, 859 bp, Homo sapiens
cctcactggtaacagagcactccaaggttctaggggaggttggaccccaaagttggaagaatctgggcacctgagtcacctgatggaggagctccaactgccaaccgggggcccccatatggacgtgtcacccagtgagaagtgagccttccattgtgacaaactgcaggtatttcaaggctaatttgttaaaatctacggttaatatgctatatatgacttttgaatagtcagaggtgtgccctccacattagactgtgaggtccgttgacttgtgtggctcgtctctgacacagactcaagcccttaataggcgcctggaaacgtatgttttcgttcacacaaaaaggaagttgaccaagcccccttgatgaagcctcactggggaggtggcccatcgaaggttgtatattgtgaatggggcgaaggcagcgtcgccgtctccttcaagtctgacctccaggttggtgttcagattccccctccacaccccacagccgtggttgcccgtctggatttggtgtttgggtcagagatgacgttcgggccgggcgtatggatgatgatgtccaaggagacagttctctcctttaccccagtcacaggaaggaagaactaagcctcatggtgacttcctgggagatacgtggtaagaagccacaagacggttgggactgagtctctgcgcaccgcatcctgagcctctgcattctgcacagcggggcgggcgcaggcagcacggtgccccttaccatgctttcttcctggactttcccttgaccagtcttggcacggcaggcgagggattgagggattggggctgggaggtggggaagacagctctctccctgggcccatg

SEQ ID NO: 390870 - DNA, 208 bp, Homo sapiens
cagtggccgcagttgtggtggtggtggtcagcactggggggataggtgttgtccctggagttgaggaggggttggtggtggagccggtggccgtgatcgtagtggccgtggtggtcagtgatgggggagtaccactggtctgtgtgctagaggagggtgttgcacatagaaccagtggccacagttgtggtggtggtgtcagcactgt

SEQ ID NO: 390871 - DNA, 549 bp, Homo sapiens
ctaccgttctcactgtttcttctataaccaatctccttcccacttctgttctcttactcatgccattcttccctcagtcatttttcttccttccatacaaattccatgtctttaaaaaggaataatcctacctcctccacatagctttccaattctctgttgcccacatttgtctccctttcaatacttctctgttgtgttatgtgacacatcacatttgatatactctgtactgtgtttcaagtattgtattctcttgtttactcaagtcattatttcaggactgactacccagtagatgctttaagtcaggatttctcaaccttggcactgttgacattttgagctggataattttttgttttgggggctctcctgtacattttaagatgtttaacagcacccttggcctctatccagtagacgcctgtactgcctccccctatctgtgacaaccaaaaaggtcttcagacattgtcagatgtctactgaaggacaaaatcacctctggttgagaaccaccgcttcaactaagttatcttctctgta

SEQ ID NO: 390872 - DNA, 370 bp, Homo sapiens
cggaattgggcattttttaacaaggaaattttttgatgataatggtagtgatgacaatgataattaataatcctgtatagttattaattctggacaaaaacatggtctggccttgtgtggtcactttccttattctctccttctttcttcctcttatattttatgtctctattccttgtactaatacagaaatgcagattgggcagggggcacctgcctttgaggaagtctgatcgtgatgagagtgaggaaggtagttgccttgagctgagccttctttgcctgtagttgggcccccatattccctccctgctgcaaggctgtttgaagacagccctagtgtttactggccttctctaccccaatgagg

SEQ ID NO: 390873 - DNA, 238 bp, Homo sapiens
ctttgaaaattaaatatggaagtgtcaacaaagcatatggtggaggatctggtgctcaaagaatattagttatcttccttaaggaacttgtgagtattggtatattgggctacaatgtgcctgctacaaaaccaaaaccaaaaaccccttcatctctacttgtctctactactaatgtcagatagtagacattaatatctgacattaaagagtgagctatttagcaccccctctggta

SEQ ID NO: 390874 - DNA, 353 bp, Homo sapiens
gacagcagttgggttcggtactatccacagtttcaggtatccactgggggatcctggaatgtatccccccaggataaggggggaccactgtaccacatttatccatttatccatcgatggacatttgagttgtttccaccttttagcaaccttctgtggatttataattctttgaaaataaaatgttaaaaaatacaatcagaaatgaaatctatgaattggctcactctttcacctactgagtatgtaaactagtgtttgttgttgacctgttgacttttgtacagttcccatcacagagacgatttaagcttggtaggccatatagaacctgattttttctttcctgcttt

SEQ ID NO: 390875 - DNA, 438 bp, Homo sapiens
tgtgtgtgtgtaagagagcgagcgagagagacgccagccgttgtgatgatgttaacattctctgggtctacaccagtggccctttctgcctgcatttttattacaacatagtcctaacactgcatttcactgtcaggcacctccgtccactccactcctgcgcactcctcccggctgtgtctcctgtcttttttgggtcccttttggaaatgtgggctcctcagagtatttggagccaccttccccccaacacctccacctctaggggcctggtcctttgggagtgggcagggccctatgaaaagcacctagcacccacggaagacaatgacatcatgtggggccaagtccgatgtcctccatcacacactattgcccagcttccatgggccttgcaagtttaaggggaaaaaaaatgggaagccatttctgagaaaa

SEQ ID NO: 390876 - DNA, 758 bp, Homo sapiens
ttattttaaataatggaatcatgctaatacacattgttcatcagattacttttttatttttaaatttctactttaactaggtaaattatcataagatgtagaaagaaaagaaaggttaagactaatccccaaccattatttcccatctcttcaatgtatccagtgttaacactccacatatatgtttccatggtaccttatcttagttataacacccgtttgatcatattgtctgtattgtctgttttttgtttttgttttttttttaatcacctaagccatgaactctttgcaaagttggatggtggcttggcttggtcattacaatgtccctggtacctgacacactgactggcacacagcaagcattcagtataaaattaaggcaatcacccagatggaagaacacatagatgaagaaattaatgccattttctttgtaggaaacattccattaaaaagctaaaattgatcctgagtgttgcactatgatgcaaaatcaagaaaacagattattttatactaaagagaggagaaaattcaaatggaatacaaacgtggaaatgtgcctggagtgagtgtatgctttctgttgccactataacagcaagggacatggatccttaagtgactgtggaatataaatgaaaattctctacatgtttacatggctggctgagaaatgtactcagcacaacgttcaacagatatctattgagcggcctgtatgtaggggctctgggttgagctctatgggc

SEQ ID NO: 390877 - DNA, 385 bp, Homo sapiens
ctggacctgaagtggccaatgactgggttctcctctccagcatgggcagtcaagcaagatgagcatccacgagccgacccccaacccctccacaatgttcatgcatggatgtccacactcctggaaactcttccaggaaggggtggtccaccaatgatctagagatggagtggggttgtttttggatactcacaggtctccactacagcaagcaaagagcccccaacattttcctgcccctccccccagacgcaaaaatgcttccaagaacaactgagatactaaatcactagaccctacatacccagatagaccaagggagtgttgggttcccacactgctacatccaaagaatgcagaaaggttcccgacaaccagttgtacc

SEQ ID NO: 390878 - DNA, 595 bp, Homo sapiens
gcacactgaggcctgtgggattaagtgatttgcctaaggtcacccacatagctagtgactggccaagtaggaattcatgcccacaccctcaaactcttagccaccactctgtctggatatgacaccaccactagaaactaagaatccatcctctagatctctctctcttccccctgacatcccattggacgtattcattcaatggcctgaatttttttttttttttttgagatggagtttcgctcttctggctcaggctggagtgcaatggtgcaatctcggctcaccacaacttccacctcccaggttcaagcaattctcttgcctcagcctcacgagtagctgggattacaggcatgcgccaccatgcccggctaattttgtattcttagtagagatggggtttctccatgttggtcaggctggtctcgaactcccagcctcaggtgatccacccgcctcggccccccaaagtgctgggattacaggtgtgagccactgcgcccggccagccgaaatggtttttgaaactcatcttttgtttcccattgccactgggtgccgccattttaagacttttaatctactgtggagg

SEQ ID NO: 390879 - DNA, 529 bp, Homo sapiens
gagagattaaatatccacatatatacccagcaagtggcagagccaggattcgaaccccaggcagttaaaagtgtatgcggtttactacattctatttaatcagtcacctccaaatatcctttttgggtatttaggtttaccagtgtttcatataaaaataaatgcttaaatggaggtgaaatctttttaagtgaattttcacacatctcatattttcttacactggattcctagaagtattattgaatcaaagtatacctttattaggatctgtattaccatactgcattccacaaagggtataccattttacattctcaaaagtagtatcatctacactggtaattactctaattttaactagtttggtgggtgaaaagggacatgacattattttactttgctttttgtgaacttaaatattgtttgtgtattgatcatttgtatttcctctctttggaactgcctgttaagataaaatgcattttaaaaattagtcctgttgggagaactttgtaggatcaagaaa

SEQ ID NO: 390880 - DNA, 2910 bp, Homo sapiens
cgcttgcgcgctggggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgaggtctcaatccattgcgcccaggctggtatgcagtcatgttgtatctggaattggtgggttcttggtctcactgacttcaagaatgaagccgcagaccctcgtgcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctaca

SEQ ID NO: 390881 - DNA, 2661 bp, Homo sapiens
gatctagaagacaggagaagatgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctaca

SEQ ID NO: 390882 - DNA, 1428 bp, Homo sapiens
cgcttgcgcgctggggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgagcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgggatctctacagaatcagaagatgttcctcagctctcaggtgaaactgcgatagaaaaacccgaagagtttgggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcagg

SEQ ID NO: 390883 - DNA, 1316 bp, Homo sapiens
cggggcgtgcggcgcgagccccgggaaacatggctgctcgtcctatttcggcgtcgcggcatggccaccagctcccggagcccagttgggagaggtgccgaaggcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgggatctctacagaatcagaagatgttcctcagctctcaggtgaaactgcgatagaaaaacccgaagagtttgggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcagg

SEQ ID NO: 390884 - DNA, 2994 bp, Homo sapiens
cgcttgcgcgctggggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgaggtctcaatccattgcgcccaggctggtatgcagtcatgttgtatctggaattggtgggttcttggtctcactgacttcaagaatgaagccgcagaccctcgtgcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctaca

SEQ ID NO: 390885 - DNA, 2745 bp, Homo sapiens
gatctagaagacaggagaagatgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctaca

SEQ ID NO: 390886 - DNA, 3037 bp, Homo sapiens
cgcttgcgcgctggggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgaggtctcaatccattgcgcccaggctggtatgcagtcatgttgtatctggaattggtgggttcttggtctcactgacttcaagaatgaagccgcagaccctcgtgcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctacaaaaagtgagaagaatcatacagtgaacagtgttacctactttc

SEQ ID NO: 390887 - DNA, 1473 bp, Homo sapiens
cagcaggagacccaggctctacccgagctctgtgggaatgtgggcacgtccttcccatgctttcagcctggatgactgcgaaggtcactcctaactctgcctcctgcaccagagcgggaaatagcacaggctccttcaggcctgttctggggtctgcttccttcaccttccagaaggaaaggcattgacttggacagggctgtctgactgtctaccacgctctaagtcctgaggaagacagaggaggcctgctctcttccccgaggagcacactgtctgaaccccagagcaaagccctagggcctggggagctgtgagccaggggaggccctggcttctctgcttggagaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctacaaaaagtgagaagaatcatacagtgaacagtgttacctactttc

SEQ ID NO: 390888 - DNA, 404 bp, Homo sapiens
cagagaacagcagcctaagtgtgactgtaatttttggcagctacagattcccaagacaactaggaagggaaaaggaacccttcaaggaagttccaggaaaaacgtctctcccaaaaagaccaccgcttcaggaaaacctgaggaagggagtgggccaacagtatcctgccactgtgaccagctgaacgaggaactccatcaaaatgagccacagctggaccaaaacagtgaggagacctccaccttcttcagtgtctccctgagcagtcagtaatttcagggcaagctgagaggtctccagaggtctaaccccagataaatagccaacagggtctagagtacattttatacccaacagggtataccccatggtgatcaaaataaaataaacctgttgtaaaatg

SEQ ID NO: 390889 - DNA, 552 bp, Homo sapiens
tttttttatttttttagtaaaaatggggtttcaccatgttggccaggctggtcttgaactcctgacatcaggcgatctgcccgcctcagcctcccaaaggctggaattatagatgtgagccaccatgcctggccagtaactgctactttaaagtaatttggggacaagacatggaaacccacaaaatgtgacatctggaagggactggaatttaagctccatgagggcagggacctcatctgttgcattattactctacctctatcacccagaacactgcctggcatcatatatatttcttgaatgaataaagagtcctaaaatcaaaagagatctctggctttaggtttccaaggattggcagatgccctccaggcaagtgtcaccttccagtgctccactggacctcctgatttaggatttttgtttctgacttcagtcacatgtcacaaaagcactgtttaaactttaatctgtcatttttgtgtggttaagaagggttcttctgaatatctaatctaccctattgctggaattttgtcaattcatatg

SEQ ID NO: 390890 - DNA, 533 bp, Homo sapiens
caggctcgtacaggtggaagcagtgaaggtcattccgtagggagggagaagtaagtagatttcatctggaaagaagcatagatgagaaatgcagctctggagagagggcagccatccacatgcagagcaaaaatctggatgcctaaagactttccaggtgtgggcctgtttggagttcttggagtggtctagtaccctttcagttaactctagtttttatgtaagctttctgttattttcagccgaaataactttgagttagacttagtacagagctctgcacagcacttgtaaaatttgaaatttagaatcatcttgtcagggatcatggctctttggaagagtagctgggattacaggtgtgtgccaccattcatgcctggctgattttttgtatttttagtagaaacagggtttcaccatgttagccgtgactggtctcgaactcccgacctcaggtgttctgtccgcatcggcctcccaaagtgccgggattacaggcttgagccaccacacccagctgttgggaagag

SEQ ID NO: 390891 - DNA, 465 bp, Homo sapiens
aaaaccagataggttatttaacaaagatcttaaattagattactgcagaagctcaactttagaatcagtggcacatagcaaggttgagcttatagacaagaccaccttcttttaagagcctgacactgaaggatgcgtgactagggtgtgagcataggagtcaaattcagcaggagacattgatcctagatcagattaaaagcaaaggggtcttagcctcagaaaagtagctgctggaacagagtacatggaaggcctgtaatttgggactgactggctaacttggtagcttttagtatggggtcaaacctaatgggacttgatattaagaatgggacttgatactgaggcttctgcctgggggattagcacagtttaaatatggcctgacacaggggtggagttgctcttgtatatgggatgtcaggagtcccagctgtgaggaactgggaattatacagactg

SEQ ID NO: 390892 - DNA, 500 bp, Homo sapiens
caatacagcagtgtcagaaataggtgtcaaaatcctatcattattggaagaaatattattagttcaaacctactgcaataatctattttctggttcatctttctgatgtgaatgaattctgcaaaataagtactgttgaaaaaagtttccaaggctacagattactgtggaagagaatactaatttcccccctaagttaattttctcctttttcctttaatattagattcccaagttttagctgagcacaagtcctctgtaaatacagattttgttggctaacctcccttgcagtcaggcatggccaagtaactaagttctggccccacaggaggctgtgtcccctcgggctggagccacaggtagctcgtggcagatccccaggccagaacccccggactttagagggacatcacctactgctacttctaagtcagttctattattagatacagaaaccaagtgctccttaattaatataaacacttcatctctgaaaa

SEQ ID NO: 390893 - DNA, 187 bp, Homo sapiens
gattgtttttattttagagtaaggcactaaaaaaactgtttgggagttctgagggagagaagcttatagacatgtggcttctagcgggaggctgattaaacccgcttttttcccttgggggaccattaaatattagtacagttaatgcgggtcatttctgtgggctgctcagtttctgaagggaagt

SEQ ID NO: 390894 - DNA, 391 bp, Homo sapiens
taaggatccccggtagtcgctcttggggacagagtctggacggggaagctgcagagactcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgt

SEQ ID NO: 390895 - DNA, 429 bp, Homo sapiens
agcctggaagccatgctgagtccttcctttccctcctcctgtcctccgatcagccaccaagctgtgtccactgtcctcacacccaccggaacactgactgcaggcagggaggggctctgcctgcttcccaacgtgtcttccccatgcccaacagcggctggcacatggcggccctcagcaagtattgtttggactacgatattgatgagttgcctgggactctgtctgctcctctccactccttcccctgtctctcttgggaccctggccattgccagcctgacttccagtgctctctccttccagactacaagcaggatctctttaaaatgcacgagcagttctgccacccccttccttcaggttcttcgtggctcctcctggcacagggtcgagccctgactcctccgaggcctctctcatctgggc

SEQ ID NO: 390896 - DNA, 881 bp, Homo sapiens
gaacagcttttgataccatttcatgttctttatttgtatgtagaaaggttgatggagaatttccaggcgcggtggctcatacctgtaatcttactttgggaggctgaggtggaaggatcgcttgagcccaggagtttcagaccagctggggcaacatagtgggaccccatttctacaaaaaataaataattagccaggagtggtggtgtgcacctgtagtccaagctactcaggaggctgaggtgggaggatcacttgagccgaggcggttgaggctgtagtgagctgtgatcatgccattgcgttccagcctgggctacagagcaaaaccccgtctctcaggaaaaaaagaaacattgatggagaattaatatgaggagtttatggtgataatcttattggaaaaggggtaggtaatttgtattgtagctgttttgcataactagcacacagttttgacttacatttgtgcttattggaggtggcttaggacttagttaatggagataaagggaattgggcctgaagactcctcatgccatttcttgctatcatcacaatgtatataagccataatttatttaaccagtcctctgtttttggacaggtggttttcatgtgtttttgtttgtttgtttgtttacatagtaatattatattctatacttttttgcactttttattatagaaattttcaaacatttatagaatggcattctactgttttgtttcatgtcttttgtgtacctcattaatttttttctgaaatatttttaaatggttctaagcataataggattttacttgtaaaagcattattatgtatctccaaaaaataaggacttaaacaaaaaccacattaccattattgattcaacaaa

SEQ ID NO: 390897 - DNA, 702 bp, Homo sapiens
actaggctgtgattctgtagttcttgtcaagttccttgctatgtatcaaagacacattaaaaaaaaaacttttattttcggttcaggggtatatgtggtttgttatataagtaaacttgtttcccaggggtttgttgtacagattatttgatcacccaggtactaatacctagtacctagtattttttctgatcctctccctcctcccacccttcaccctcaagtaggccccagtgtctgctgttcccctttgtgtccatgagttctcatcatttagctcctacttataactgagaacatgtagtatttggttttctgttcctgcactagtttgctaaggataatggcctccagctccatccatgttcctgcaaaagacatgatctcgttctttttttatggctgcatagtatttcatggtgtgtgtgtaccacattttctttatccagtctgtcattgatgggcatttaagcagattccatgtctttgatgttaagagacacatttttaattgaatctaagagtagtaataaaatcaaacaaaatatcaattaatggcaggtgggaactcttttttttccccacagaaaaacaattctgaagtcttaacctctttatgaaactcaaatctgactgggtatggtggctcatgcctgtaatcctagctgctccgaaggctgaagctggaggatcacttgagcc

SEQ ID NO: 390898 - DNA, 334 bp, Homo sapiens
ggccagctttaagcactcttaaatatattataccacagtttgggaagctctataatctcctttattaaactttttgctatacctttggaaacattcatttaacttaacaattaaacacttaatccattctgaaagtcagcctgcaaagcagaaatgatttttggggtgttatttggtgtaaagagtttttttttttttaggatatcatacttaattctggcatgacctctttagtgtcttttaaaaaactctcattttataactttgggcatttctagaaaagcaacatttttctcacagttttctaatgcaaaatacacagaggggtaggtgg

SEQ ID NO: 390899 - DNA, 321 bp, Homo sapiens
ggcaacatggcaaaaaccagtctctacagaaaaatacaaaaattagctgggcgtagtggtgcatgtctgtagtcccagctactcaggaggcggaggcaggaggatcacttgagcccaggaggatagcttgacccagcctggaggatcatttgagccctggaggcagaggctgcagtgagctgagatcatgccactgcactccagcctgggtaacagagtgagaccctgtcttaaaaataagtaaataaataaatttgatctttcacactagaattttaagttccccaaaggctcgggcattgtgcctcatttttttgtcag

SEQ ID NO: 390900 - DNA, 116 bp, Homo sapiens
ctaggtctgtaaccctttactctaacgagctgacacagtgcagcaagtacagcctgctcataggagcccaggaagagcaggaattaagcactgacgcccagccctgcacaagcctc

SEQ ID NO: 390901 - DNA, 557 bp, Homo sapiens
ctcggctctaccgtgtctcactaagaggggaagcaaaaagctaagaaacgtttatgagtgtgttcacagtccaggacacaggcccactaataagactgtgatttaatttatgatgatagaatgcttcctctcctcaacactctacaaccaaactaacggggccccagtataatgacagtggattacagctgaaagaaccaaaagttacagactctatctgagaaaaacttcttagggaaggcaaaagaaaactgggaagctaaaaacaaacacactagaggaaacgggagccatgggcacctaacagctacagaaatcatgaaatataggcccaactcctagccatattaacataaatcctaacactaaaggcctattcagctcctatgacccaagacaaaatgtctggctttcaacaaaaagtgcaagggcacacaaaaaagagagataaaacattgtctgaaaagacaaagcgagcatcagaatcagactcaggtatgacattgatgttggaattactagaggatttacaataagtgtgattaatgtgtggatgg

SEQ ID NO: 390902 - DNA, 335 bp, Homo sapiens
gtttctgcttcttgaaataaatcgcccaagagccatggccttcagaatcatccttggcagaatgacagatgccatcaatgtgtgtttgggtgctacttctggacttactcttagataaagttctggatatttgtgcccaagaagaagagtaaaggatggtggtcaacattattcaccagatgagatagattgttcatatgtgcctaagcttaaatttgtattagtttcatagagatttggtaaaaccaagcagggaaatgtttagacacaagttagaacccgcagttctgtaacaagaggtttagaccagggacccttctaaatccccagaatgt

SEQ ID NO: 390903 - DNA, 541 bp, Homo sapiens
aaatatgtctgagtgaataatgcacagactagggacagtacaatttacacaccaatgccatatgtcatcagaaactgtggacacagatttgctcattaagcagatagtgcaaatatgcatatatttaccatggccactgcacaggcggccgtaatctgattgaagcaaaaaaggaaagtccctcaacctgtcaactttcagttttgaggactggattgttatatttccagtggaatgattctcctgttaattttggaaatcatggccaaagcccacagatgagaagggaatcccagggtgtaatcaaacattacacacttttaaaacagaggtaagttctggaaaattataacaaaatactgtttttaaaaagcacagttttgggctgggcacggtggctcatgcctgtaatcccagcactttgggaggccacggcaggtggattacgaggtcaggagtttgagaccagcctggccaacatggtgaaaccccatctctactaaaaatacaaaaaattagccaggcgtggtggcacacacct

SEQ ID NO: 390904 - DNA, 847 bp, Homo sapiens
gttttgagacagactttcactctcgttgcccaggctggagtgcaatggcacgatctcagctcactgcaacctccacctcccgggttcaagcgattctcctacctcagcctcccgagtagctgggattacaggcatgcaccaccacgcccggctaattttgtatttttagtagagacggggtttctccatgttggtcaggctgatctcgaactctcaacctcaggtgatccacccacctcggcctcccaaagtgctgggattacaggcatgagccaccatgcccagccaaaatgccctccttttaaagctgaaatctgccttcttacaactcctgcccccattctactctctgtattccaaaagagcaaatctacctccaatcttcttcttttcccatgactgcccttagggtgtttctctcccttgacttttctccggacgatgccttcccgttgcctttcccctttgccatgatcttgaggttcctcaccaccactctgatcatcctccactgggaactctaatttttaaggtcagctttgcaatgtgatactctgagaagagctgcttctcactgaaaatacatgcataagggctaggtccttatctatttgtttacctctgcatgtaccataactagtatagtggctgtcacacacacaaagggtgctcaacaaatgtttgtttgatcccagttgctcccatatctgcagcatatcaatagtatattttacattgaccctaggaagtttaagcatttttcctctccattttatagatgggcaaaggaatcctgtaaaaaggcagtgatcattgactaatcaagtcttccagccccagtctttga

SEQ ID NO: 390905 - DNA, 460 bp, Homo sapiens
aaagaaggaactaactgggtaaagtttaacagaggaaggaaatttcaagatactaaaagctcatcaggtaaacaattttctatctcaagaacaaatgataccagtgcacaggaatgacagaaagaataacaagatactaaattggctataatcagagacctgaaagtcaaatgccaaagccacaaagagtggaattcaagccagagccctaaagaaaaaatagcgtaacgagagagagccagcaaaaagcaaaatgaaaaagacgcaactcttgtcatagcacacacatgcaccgaaacaaaacaaaacaaaatgcaggaaaaacagtaaaaaattatctagctgtaaaaattacttggctgtacagcctcaattgtttgctccctgatttagaaattatcatatttgccaaaagtttgaatggaaatatacttttacttagcaaaacttccattattaa

SEQ ID NO: 390906 - DNA, 422 bp, Homo sapiens
actctgtcctgtgggtctgtccactgacctctcctctcttccccgatattccatgcttctctctccttctaggactggctttctgaaacatctggtggcctctcttctgtccccagtctattactcttgcctgtggctccatccacccttctcccttggtctgcctgtccccctcactctccaagcttggctgttagtaacaataatgacgatgatcataacaatgacaatcaccgcccacacaatgtgctaccttcatgccaagaactctactaaccactttgtccttattaactgtttcctcctcccagcaccgctagaaggtagacgctattagcatgtccattagccaaggacacacaggcagcaagtggagggtgaacttgaacttcaagctccagaatcctgctccttcctgacct

SEQ ID NO: 390907 - DNA, 463 bp, Homo sapiens
agaaatctcaacatattatatgatggcgtcaagcttgtggggaaatatattaggctagtgcaaaagtaattacttgagcagtttaaacaagcaataaataggtatgccaattcttttccttaacataatgtctacacgtcaaaaacctaatgtacatgtactcatctcaataaaatttctcatagtaaaatgactttgctatctagtgtcaccaagcaaggtaacccctacatcatctcacctaaatagtttactctgctaggtaaacatgatacaatgcaacctcttacccatctgcccataagggaaattagaaatctcaacgcgtgatacttcctgtgaaaaagtaaatctgatgcacagaggggcttggaaatcacttttccaacctactttgcacaaaatgatgatttctaatttcccttatgggcagatgggtaagaggttgcatggtatcagtgtt

SEQ ID NO: 390908 - DNA, 472 bp, Homo sapiens
agaaatctcaacatattatatgatggcgtcaagcttgtggggaaatatattaggctagtgcaaaagtaattacttgagcagtttaaacaagcaataaataggtatgccaattcttttccttaacataatgtctacacgtcaaaaacctaatgtacatgtactcatctcaataaaatttctcatagtaaaatgactttgctatctagtgtcaccaagcaaggtaacccctacatcatctcacctaaatagtttactctgctaggtaaacatgatacaatgcaacctcttacccatctgcccataagggaaattagaaatcatcatttgtgcaaagtaggttggaaaagtgatttccaagcctgctgtgcatcagatttatttttttacagacaactttcaggtctcttacacagagattctcaaattcagctgactcaggaatcccaacccccataattctgatgcagccagc

SEQ ID NO: 390909 - DNA, 856 bp, Homo sapiens
ctactttgaaggtttaatatataataatatttaggttgagtcactttggaagccaggattaaatcattttatgaaatatctgttgtaagtatctacaatttggtaccttttagagaaatttacggaataatagtaaattttgaagcaggatgccatcagtctccttgtattgaattttataagctgaacctaagatatttttttatgtgtcatgacagaaatgtgaggtttggtagccaagtattataatgaggtgtcactactcaccatcttggctctcagtcctaccactaacccttattttaccgcacacatgaagtacctcacaggaccaggtcatagccgacatctgattgctccacctctttgaagacttcttcgtaatgtacagagccgtctgcaccgtgtgcagagcgcattccgaccttgtgtcctcctcatttcactagcatggtctcattccttgctcagctctgtttgtgtcgcgagcactctggtaaagcatgcttctgcagatggactgggcttcttccactggacagtgagaggagcagcattaggatgtgaatgagtaatgccagatttgaacatagcactgtatgaaagattcattactaaagctttttgaaaatgatctgtgatttggagtattcatagagagtcagctgaaggtatttgatactcttaagtctaaaagttccgaaaattcagaagaattagttttaccagtggaagaagccagtatcattcttaaagctcaaaagatataatacaatgtttttaaaactaagcaagataaaaaatttggaactaaaattgaaaaaaatgtctccatgcggtaatttatctaaaggcc

SEQ ID NO: 390910 - DNA, 312 bp, Homo sapiens
ccacttggacaattgccgtgaaacctccatttctgccaagctcgtttactgcgtttttgtggacttacgtgcagcttctgtgagcttcagtttaatcaacttgaaaattgagggggttgcactttgcgctcagaaattttacgtgcatttttgctttcctgatttcttgatctcctctattttcttagcttcaaaacttttccattttcctagagtcaggatgttcctgggtgaatcatgtgtccctctaccatggactggatgaatggttttaaggtagacataggatttcaagatcctctagggtaggtc

SEQ ID NO: 390911 - DNA, 357 bp, Homo sapiens
cgcctctccactgcccctgcaaagaaaaagtcctccatccttgccctgccacaactactggacatcttcaacctttccaccacccaagactctgttatttaccccacagaatctgtttccatcaatggctatgaaaaaacagagagtgatttaatctgttcgctttttttttaaggccatcaactgtcctgagtcatcacactaagtgtctgtcattctaattggatgcagaggtgtttttacaataagcctgggcagctttatgtcaaatcaatgaacaatttccaaccaccatttgtaaacaataataaatcaaggactctcgaaacggaacccccaaggtataaacgttcccct

SEQ ID NO: 390912 - DNA, 294 bp, Homo sapiens
agggaagaaatgaagttcaagaagagtgaggcaatcccggaaacggattgccgcactaaacagcaataaaggaagtggagacactgatggaaacacaaccaaatatatggaggacacattccagaaaatcccagtgattggctcaagaaggagcacatgactcacagacattagctgcagactttctggaacaaagcccaagaaagctatcagaagaaacattctccctggctaacattatgtcgccagctgctaccacggtggaagtcagcccaaagacagggccacataaca

SEQ ID NO: 390913 - DNA, 457 bp, Homo sapiens
gagtgcaatggcgcgatctaggctcactgcaacctctgcctcccaggttcaagcgattctcctgcctcagcctccggagtagctgggattataggcacctaccaccacacccagctaatttttgtatttttagtagagacggggtttcaccatgttggccaggctggtcttggactccggacctcaggtgatccacccgcctcagcctcccaaagtgctgggattacaggcgtgagccactgtgcctggccttttttccctaatttttatcctgcctaccacctcccatcatctccacgaccaagtcccctagccgctcgcaaaccctccctctacactgcccgcaggtgtagctgccgcttccctcgaccaccctctccaactggcaccaccctgtcccttctcacacacgtggagtccttcagcaagacctgttgcttctacctcccaaatacat

SEQ ID NO: 390914 - DNA, 244 bp, Homo sapiens
tctgtaatacacttaacaatttggcagcgatagattttgaggtgagttataggcttaacagggtccttgccattagataacatatttaagaggagaggcaagttaagcacacataaagtgagtgacaactcttaatcacacgcattggatacagatcattagcacctggctcggtgccccgtgccttctgggctacctccccttacattggatatacagtcatgttaatattatcctctgagaa

SEQ ID NO: 390915 - DNA, 188 bp, Homo sapiens
tgtcccctacccctccctttggtaaagaacagtacaacaccaaaatccacagataatccttgaatctctgtggcagctccagttctaaactcctccttcacaatcatggtttaaatggctgttaacaagtcataacaaagatctcttttgctccagggtagaatagccatatcctttctctttcccca

SEQ ID NO: 390916 - DNA, 367 bp, Homo sapiens
gcgggagttgtaaatggagggccatctattatgtgtgactggtattgtataagttactaagacgttgttgagctaatgttagtcctacaaaggccatctagtccccaggcaagaaggagttctgcttggggaaagggctgttaacatctttgtttaaactataaactaaattcctctcaaagacagttcagccgacacccaggaatgaacaaggatggcttgagattagaagcaagatggagttgattcagttagagctcttccgctatctcagccataattttgcaaaggtggtttcgaataatccacctggaaattctctggccctacctcaaaagtgcatccagagtctcaccccttctcactg

SEQ ID NO: 390917 - DNA, 275 bp, Homo sapiens
cacgcacacacacaccctgactgcacccacccatggccacacgttcaggcacaatctggggacatatctctccttacgccacacgcccatgtaggacacatctgtgcacacagtagagacccacagtgacacccactagtaggcacacacacaccatgcacagccccagccatgggacggctgccagccccacccatctgttgccacacaaacgagcccccaacaccctgtcccatctgggtgcacgaagccagctccccgcggtcacacactgt

SEQ ID NO: 390918 - DNA, 504 bp, Homo sapiens
ctgattttttctcttgtcttggaatttgccaccagtatgcacagccaaggacaaagagatgctctcagttctccccagcctggataactaaaagaaaagaaggaggatccctctagttgtgggttgtcagcctcagagaggaaacctggcagagttggagctgcaggctcccaggtatcactcatagaaactgcaggaaggggagatggcatctttttcccaggttggatgtctactttgaaatgagctcactgctctgctcccagtgcctgtttgaacaagggcaaagagcatggggaaaggtggcaagggtctctgggggccctctcactcccattgtccagcatgtattccatagtcagtagtggcctggtcacgtgtttcctcttccaggaaacaactgtgggagagtgttgatttggggagtcagcccggtcaaaggcatgaccttttccccaggaaccttggtctcctccagccaaagggcagaggtcattggctgaa

SEQ ID NO: 390919 - DNA, 116 bp, Homo sapiens
acccatatatgctcaccacctaatatttgctttagttttaattgaatttttaaaacaatgaacatttagcgttgctttaaaagaccaaatgcctcttctcttcatctcccttagtg

SEQ ID NO: 390920 - DNA, 378 bp, Homo sapiens
tcattcagactgaaagagtgtaagtagaaaattttgatcttcttattaagattaaactccaaatgagcaaacttgcttctgcttaaagcaaactccttgacaattcttccagactgggctgaggagggtatgtgaaaagtatgagacatgtctctgctgtcagagaaattaggaaaggattgttgacaacatacataaaactatcaaaaattgaaaactatgcaagatagtatacaactaaatggcatattggctttaagtgttgtaggagttcaggttgattattttagtctaagcctccttttgagggcagctgggaattgagattccttttttttctgatgcccttactgtttgtctcattgaattagagcttgt

SEQ ID NO: 390921 - DNA, 349 bp, Homo sapiens
agcatgtagtgagacctgatccctacttaaaaaaacaaacaagggccgggtgcggtggctcagcctcccaaagtgttaggattacaggcatgtactaccgtgtctggccacccatatgattttcaagacaaagttcatccctgggacctgcaggccttctcttgggccacaagaagtggaatcaatctgccctcacctccttcctgggctgtgggatatttcattgccaagaaacgtgtctgggtgcacatcctacccaggctttgccgtaccccggagatatcacacagggaagccagattcagagatggtgggattcattcccttaatctccttaatcagagctgcg

SEQ ID NO: 390922 - DNA, 206 bp, Homo sapiens
aaatgccctgcactctctagaacttgacatacatattatgagtaatacacatgaaagaactttgtgaacttaaggagtttgcttagagaagaaataaggcagcagatatggaaagagttctctccttagagttcaaactcctggactaaacttaggctgtgccctccacaaggtatggccttggccagcctaggggaatctctgaa

SEQ ID NO: 390923 - DNA, 222 bp, Homo sapiens
aacagcctaagaaagaatgtgtcacttctgtgcccaagatctcgtgggctggctggccccacaggtgtggcatctgaaagagctcagttctaggccagcttgaggctgcatgttgtgggctacctgtcaatctagttctatgaagatgcctattgtcctgctaattactgtagagtgatggggctgcttgtttaaagcataggttattgccctcacatccag

SEQ ID NO: 390924 - DNA, 403 bp, Homo sapiens
ctgaggaggcagaggacggcccggagtctcgtagcgcaccgccctggtcccacaccccccgcagccctaggaggatcggtgtgctgagcttgtggccaggagctccccgagccactttcgcgcgagcagcagaaaacctgagccgcggcccggcgagtgtcggcggcgctctggggaggagaggctgggaaggggctgcgagagatgctacttaagaacgtgaggctgagaggcggacttggtcagatctgcctgcgtgacaagctcaggacaggacgcttctgcccttgcattactgttgtaaaagtttccacccagtccctggtcgcactgcgttcccatcccggcagatgtgaactcaaaaacttcctccgctgtgcagtttcaattggcagacacaccc

SEQ ID NO: 390925 - DNA, 135 bp, Homo sapiens
tgcggttggcctgattctttgcagtgcacattctccagccagtctctctcctgactctgcctttccctgctgcctgccaggtgcagcctcagcaactgctgctgtcacaggacaagtaggacaagcaatccatgt

SEQ ID NO: 390926 - DNA, 430 bp, Homo sapiens
atggatgttggatgtgaggggaggagtagtcaagtacgaaatcaaggattatggccggggcaactataatagcatagtagccatgaactaaaatggggaaagctgtatatggaagagcctaggaattccgccttgggcatgttcagtttgcaaactctaccaactaaattataactaaagatatggagtaggtagataatattcaagttgagtttgagagagaggtctggcttggaggttgtcaacacagaaacagcaaagccataaaatcagctaagaacatcaggaagtcagctgtaggtggaaaagaacaaggactgaactcaagggcacttcactgataaaagggcagagagatacagaaaaatctgtagaggagactgaaaggatatgcagattccagaactcttgccctgaatcaatctagcaa

SEQ ID NO: 390927 - DNA, 329 bp, Homo sapiens
gtctggaacacagatttactcaagatctgtacataaacccttctctgaattaagatactgtgttacttctttatggctttactaattatattgctagcagcaatagttagccattgctaagcttaaaatatatattgatatactttgttttcctgatatacttcagacctgtttgttcgtgtacttgtgttgaaatcaattgtttttaatcaatggctttgtgacctcaagttcacttgtgacaagtatgtgtcctctgtttgcatgttgacttctaagacttacctgaagtaaatgtgggcactctctctctcttcaggacaactcac

SEQ ID NO: 390928 - DNA, 241 bp, Homo sapiens
gctcattggtatggggcatcagtctgagaaacctcagcaggccaagggcaccactgcattcagtgtaatacagtaactggagttcataaaaatgatgactctgggtcaatgagagaaaaattacaacaccttcagtaaactctgtttaaacatgaaatgtaaattttagaaaaatattcatccagccgggcatggtggctcacacctataatcccagcactttgggaggccaaggcgggca

SEQ ID NO: 390929 - DNA, 282 bp, Homo sapiens
ttatccgttcagtgacccatcaagcaaattaacacagccgtatttttaaagcatgctccaacaataattactttaaaacatgagaggtgtcttatataggtactatgaggaagaccaggtcatatgtggactgtctccttggccatggacaaggcaagggtgagaatcacaaatcaaaaaccacaagtttcacaaagaaacatcagagtaaataaatctagggcatggcggtacaggatgggtgggttccagtgcagcatgcatggaccagtcactgaaccc

SEQ ID NO: 390930 - DNA, 338 bp, Homo sapiens
ctgaggttcacggaggacaggcaacttgccacgctggcacgtggtcatggggtggggatgtggccgactctaaagctttctctgtctgtagagttgccctttgtgtcatgccctggggtccaggtttgcagcttaaggtgctcactccccagggtaggctaggggaagagcagagataggtgctggggactgggcctccaggtgtaccccaccaccaaagtcctgggtgaaaaccagcaggaagtcttcaggtgtctctgttccctgagggacattctgtccctcaatcgtggcgggactctgggctagtggctgcagggcattcataaacaagccca

SEQ ID NO: 390931 - DNA, 348 bp, Homo sapiens
cactttgaccacttcttactgagtgctggaaatattgccagttagtatactaaggctctgttaagatgagggattttttttccacattggatttatgatgtgtcttaatgtgataggttttgcttgttttgaccatatttttgtgcctctctgttgggttaacaagtccagctttgacatacttcctgtagtcatcgtttcttaagggttgagtaattttatgccttatctgggacctcatgatatcatttatttgttaacggtatttggaaaaaaattaatttgagatgccaaatggtattatttttcctctgatgagatagaatcagttgttgttgttgctatgat

SEQ ID NO: 390932 - DNA, 567 bp, Homo sapiens
atgtgccaaacgtctagtgagaaaaacatgaagctgggggtgacgggtggtatcaataataattatacagcttttagagtttacagcacactttttgtttgtaattagtaatgcttctgaaggtgtttaaaaattttgctaatactagaaaccctctattaatgagcttgataaaattttaaggatgaatagttgttcctgaaagaaatttttgtaaggagtacaaaatgccactgattttaagtccttggagagactgtcttactagagagagcaatgctttcatgttccgttttcaatgttatccatgatgaaggttttcacgctactagttttatagcatgaacaagctgtaacactagaaacaaagatgttatttctcctctcttatccaacctccactcaactaaaatgttttttaagagaatatgtgaaaaggtttacactatcccagaaatggacaataaccaattaatggttactttttaagcacagttttgtgatttttttccaccaaaatgcgtgggtttgtttataatgtgataaatggttgtggtttggctataa

SEQ ID NO: 390933 - DNA, 990 bp, Homo sapiens
gaataggaatttcttcatttaggtcagcgagatgtgctgacaagatgaccacaaatgcaggaatgttggagtggttaatatgtagatgagaaatcatgaaagagtggaatagcaatgcaagtttctggggctacttcagtagggctatttgggactgattgagggggcaaaaattaaagccagaaagttcagtggagcaaatgtcctagtggccacagagaaacaaagatttccaaagtgagatgctaagtgagaaacagcaactgaggagagaagtgatgtttccaggatcacaatgggcataaggagaattgttcttttagactctaggtgagcttgtagtaatccaaggactggtgatttaggccactgagttctggctttgagtacatctctaattcctaaaccttcactaagagggaggtgaagggagtcaggtgtgccacatgtctgctactgaaaaatgcctagatgggaaaggagtttgaaatattgtcctaaaatgaagtttctgagttagatggaccgaatttcaccatgtgttcactgttattactgtgtaaaatcaagagatttaaatgagattacgattattaattagctttctgagatattgaaacctaagaacctggccgggtgcggtggctcacgcctgtaatctcagcactttgggaggctgaggtgagcggatcacctgaggtcaggagttcgagaccagcctggctaacatggtgaaactctgtctctaccaaaaatataaaaaaaaaaaaaaaaaaaattgttgtgcggcggcctggcgcctggagaaaggtttcacaccccatcggtgtgggcgccggggcccaaggtggttcttcgacacttgccaagagtggtcccaaagaaacggggcagaacggggtggggtttcacaataaaaaccgcggggcaccgggggtctggagactcaggggttggggcaaccggctaaaaaggtcacgagcgtaagcg

SEQ ID NO: 390934 - DNA, 278 bp, Homo sapiens
attggctcctgtccttgttggtgtagccctcagcacagcaaagaaatctttgtgctgactggcctgcagactgggagctttcaaaggaagcccatagctcctccccttcctcccctctgatcctactaacgggcttatttgcatagctgtcttggtaacagaaaagaatgtaaaagaagaagcacttcagaagcacttctcttactcctaatcctttctagaactacttcccctcttcttgtagctactaacacctgttcctctgacctgcacaaaag

SEQ ID NO: 390935 - DNA, 411 bp, Homo sapiens
tgccactgtatgaatccgcttaaaaaattattttgtagttcaaaaacgctctgcatttgctaactgtcttaacttggtgtcactcatttgttactttgttggcttctccccataaattatcttccacattttcattgacaaggaaatagggattggaacatgtgttacaatcaccaagaagagagggcaaaatcatttccttcagggtggaggcagccgctctcaccggctcaaagtggcttcccctttgtgattctgtgtgggaggcagaagaggctgttggtccaaatgcaagattcaggctggacaggtggacacgtgtccttaggcccatttccatatccatccattcagtaaatatgtattgactgcccatcactttataccagccactgttcttggcagtaacca

SEQ ID NO: 390936 - DNA, 762 bp, Homo sapiens
aatggtggtgggcgcctgtaatcccaactacttgggaagctgaggcaggagaatcgcttgaacccagaaggcagaggttgcagtgagctaagatcacaccattgtattccagcctaggcaacagagcgagactctgtctcaaaaacaaaacaaaacaaaacaaagctgaagtatacacaagtagtagttgaggataaagcaaagcaacatgccctttcagatcagaaagacttcagttcaaaaccacacttccactctggactggctctgtgctcttaagcaagtaacttaatctcacaaagtctgtttgctcatctgtaaaactgcaatgataatacaatttgactaaataacatatttcagagggcccaaccctgtgacaattttaaataaatactgttaactcattcactaaatattttttccaaaaaaatttttaactaccatagaaactatttaatcaaaactcttctgagggccaggtgcagtagctcacacctgtaatctcaacactttgggaggatgaggcaagaggatcacctgaagccaggatcactcaagaccagcctgggcaacaaagcaaaaccccatctctacaaaaaatacaaaacaaaaattaatcaactatgctggcgcacactttgttgtcccagctactggggaggctgaagcaggaggatcacttgagctcaggatttcaaggctgtagtgagctataatcacgccactctacttccagtctgggtgacaccatgacatgcc

SEQ ID NO: 390937 - DNA, 2637 bp, Homo sapiens
ccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctttaaagaagatgtaattcaccagagcaaaaactgtgtctctgtcaagctccttgaccaaatccacaattttcccttgagtacccttctccacgtaatcgttgatctgtttcttggcctcttcggtgtccccgaagttgacagtgaaggcttctgagtggtacaactttttaacatcctccaaaaacttatccactagcttcaggccctcgctgaggaacaggccattgccggtggtcagctggagctggctgtctggctggttgagggtacggaggagttcctggaagccttcatggatctgagcctccggaatctccgtgaggttgaaattcaggccctccaggatttcatcgtgagtgtcagccttggtccccagggagagcattgcaaaggctgtagcgatgctcactggggagaagaagatattggtgctgttggactggtgtgccagctggcggtataggctgaaggcgaactcagccaggttgggggtgatcttgttgaaggttgggtgatcctgatcatggtgggatgtatctgtcttctgggcagcatctccctggggatcctcagccagggagacagggaccaggcagcacaggcctgccagcaggaggatgccccacgagacagaagacggcattgtcgattcactgtcccaggtcagtggtggtgcctgaagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaactcttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctccatcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtccca

SEQ ID NO: 390938 - DNA, 2485 bp, Homo sapiens
ccagctcaacccttctttaatgtcatccagggagggggccagggatggaggggaggggttgaggagcgagaggcagttatttttgggtgggattcaccacttttcccatgaagaggggagacttggtattttgttcaatcattaagaagacaaagggtttgttgaacttgacctcgggggggatagacatgggtatggcctctaaaaacatggccccagcagcttcagtccctttctcgtcgatggtcagcacagccttatgcacggccttggagagcttcaggggtgcctcctctgtgaccccggagaggtcagccccattgctgaagaccttagtgatgcccagttgacccaggacgctcttcagatcataggttccagtaatggacagtttgggtaaatgtaagctggcagaccttctgtcttcattttccaggaacttggtgatgatatcgtgggtgagttcattttccaggtgctgtagtttcccctcatcaggcaggaagaagatggcggtggcattgcccaggtatttcatcagcagcacccagctggacagcttcttacagtgctggatgttaaacatgcctaaacgcttcatcataggcaccttcacggtggtcacctggtccacgtggaagtcctcttcctcggtgtccttgacttcaaagggtctctcccatttgcctttaaagaagatgtaattcaccagagcaaaaactgtgtctctgtcaagctccttgaccaaatccacaattttcccttgagtacccttctccacgtaatcgttgatctgtttcttggcctcttcggtgtccccgaagttgacagtgaaggcttctgagtggtacaactttttaacatcctccaaaaacttatccactagcttcaggccctcgctgaggaacaggccattgccggtggtcagctggagctggctgtctggctggttgagggtacggaggagttcctggaagccttcatggatctgagcctccggaatctccgtgaggttgaaattcaggccctccaggatttcatcgtgagtgtcagccttggtccccagggagagcattgcaaaggctgtagcgatgctcactggggagaagaagatattggtgctgttggactggtgtgccagctggcggtataggctgaaggcgaactcagccaggttgggggtgatcttgttgaaggttgggtgatcctgatcatggtgggatgtatctgtcttctgggcagcatctccctggggatcctcagccagggagacagggaccaggcagcacaggcctgccagcaggaggatgccccacgagacagaagacggcattgtcgattcactgtcccaggtcagtggtggtgcctgaagctgaggacaggatggcaggagcgcccatggctgctgctgtacagcctgctgaggtgactgttgaagttggtgaggacctccacatgcaccaggttcgtgaccgggagatgcctgaagctttggagtttaacctttctgccaatccagaggcaagcacaatattccagaggaactctcaaacagatgctttggagtttaactcttctgccaatccagaggcaagcacaatattccagaggaactctcaaacagatgttgtagaaataagaagaagcaactgtacaaaccatgtatctactgagcgtttcagtcaacaatacagctcgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgaggcaggagaatggcgtgaacccaggaggcggagcttgcaatgagctgagattgcaccactgcactccagcctgggcgaccaagcgagactccatctcaaaaaaaaaaattagctgggcgtggtggcgggcacctgtagtcccagctacttgggaggctgaggcaggataatggcatgaactcaggaggcaaagcttgcagtgagcagagattgtgccactgcactctggcctgggcaacagagcaagactcggtctcaaaaaaaagaaaaagagggttacagatcattgcacatggaaaatattcccagcagtaaccacttccattaatgtgatctacagcttttaaaaaggagcatctcagaataagatggtggtacaatttgcttattgagaaagg

SEQ ID NO: 390939 - DNA, 917 bp, Homo sapiens
agactctagcaggatccccatttccagcaaggacaataatatctgtgaccttagagatacctcatcatatcacacaaagagatgcagatagatctttgagcatacctgatgaacagttacactcatttgcggtttccaccgtgcacattatgaagaaaagaaatggaggtgggagtttaaataactattcctcctccattccaccgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctccatcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtccca

SEQ ID NO: 390940 - DNA, 326 bp, Homo sapiens
ggctagtgaacacttgaaatgtggcttgtgttactgagaactgaattttaaattttacttaatacaaaattaagcagccacatgtggctagtggctaccatgctagacatcgcagtattagaacataaaaaaattctataagtaactagaatactggtagtcctagacgtttcttgcattctgaaagccatagaactgaagttgttatgtatggttatttctactttttaaaaaaagcaaattcttgctggtctatataatagaatgacttattttcttacgtggtaagaacagaaatcctacaaggaactgggagctaggctggc

SEQ ID NO: 390941 - DNA, 339 bp, Homo sapiens
tgctgttatttcattgaagctaagatataactgattataagaaacataagtttatgtatcactaagaaaaaatgctggcaactgaactacgatatgccattgtttataaaagccatccaattttggatatgttaaaatgagaactgcactctagcctgggagacagagtgagaccttgtctcaaaaaaaagtgaaaataggtgcatctcagaactgatcaaatataatattgtaactatgatgaaaacatttgactcaaatcaccttaggaactgggatttgaaattcactcataaatatttaaactcaatattttcattactaaattgtagctgatgg

SEQ ID NO: 390942 - DNA, 262 bp, Homo sapiens
agtctccctggaaccaagcagccaaggcaggctaatggtgaaggcccaggcacagtaatggtcccctggagatggagtcctgctctgtcatccatgctggagtgcagtggcgtgatctcagctcactgcaacctccgcctcctgggttcaagtgattctcctgcctcagcctcccaagtagctgggattacaagtgtgcaccatcacaccctgctgatttttgtatttttagtagagacagggtttcaccatgttggccagg

SEQ ID NO: 390943 - DNA, 454 bp, Homo sapiens
acagtattagggtgggagtgtcccaattttccaggtaccgtctgtcatggctttccttggctaggaaagggaattccctgaccccttgcacttcccaggtgaggcaatggccctgcccctgctcccatgggctgcaacccactgtctgacaagctcccagtgagaagaaccccagtacctcagttggaaatgcagaaatcacccatcttctgcatcattcatgctgggagctgtagactggagctgttcctattcggccatcttggaacctcctcactttgctcattttagtgtttagaaacacagtccaaatcagaaaagctcaacaagccctgctattatgcaagagcaaaaatattgagaaggaaaacaaaatggtgaataaataaaagcctaaagaaaactagagaggaggaaatgtgtgtttttcccatctgcccttatggaggaaaaa

SEQ ID NO: 390944 - DNA, 322 bp, Homo sapiens
tgatcaataaatatgtgatgaacagaaagcatgaatgaaggaagcccaaagaattaaacagaatttccaatgttattcagcttaagtaggggaatggacactagaagctaggtgctctcaatcttgtgtgctttacattccagaggtttctccagcctccttcctcacctgttcctcaagaattatcttgttctgaaaaatatcaacataatttaaaatctctaactacagtataaatgttcccttcaaaatctcatattgggctgggtacggtgctttatgcctgtaatcccagcactttgggattgccgaggtgggatga

SEQ ID NO: 390945 - DNA, 893 bp, Homo sapiens
  misc_feature (709)..(709): n is a, c, g, or t
gcaggagaatcactcgaacctgggaggcagaggttacagtgagccgagatcattgcactgcaatccagcctggcgatagtgagaattccgactcaccaaaaaaaaaaaaaaaaaaaatcatacatagtaaaatggtagcattttttgaatatgagtggaagctacatgagtgttttaaatatttcataattttaaaatcactgggtgcaaatgactatatgaataaaagtgtccaataaactgtactcttaaaaactaacaaatatatgggatatattagatacttgatggatttatatttggcataagtaaggttatattcacttttcatccatcattgcatatatgtatcaagtatgtgtgtactggcagtatttatttagcccactcaggtagaatttattcttcccatataattacagggtattatcatcaactaaattaaatcagaaaatgaatgagaaagcacctcaaagtaccaggtctatacagccattctctagatcaaacttacttacaaacacacacacaacatgtacatagttttatttatttgtttatttttctcacagatgagattaacatgggctttggagtcataaagactgaatttgaatctaattgctatcatatcatatctcctatatagatggactcttgggaaagttaaataaatttctaataatattacccttgtagttagacaatnataccaacttcttcttaaggttcttatgaagataaatttgtaaaatagccgaacattttctgacaagtagtaattattgaataaacattgacctccttccccatgtgtttctaacctcctttgttagtaaagttttttttttttttttttttgtcagcctgggcaacagagcgaggtccctctc

SEQ ID NO: 390946 - DNA, 505 bp, Homo sapiens
gcaggagaatcactcgaacctgggaggcagaggttacagtgagccgagatcattgcactgcaatccagcctggcgatagtgagaattccgactcaccaaaaaaaaaaaaaaaaaaaatcatacatagtaaaatggtagcattttttgaatatgagtggaagctacatgagtgttttaaatatttcataattttaaaatcactgggtgcaaatgactatatgaataaaagtgtccaataaactgtactcttaaaaactaacaaatatatgggatatattagatacttgatggatttatatttggcataagtaaggttatattcacttttcatccatcattgcatatatgtatcaagtatgtgtgtactggcagtatttatttagcccactcaggtagaatttattcttcccatataattacagggtattatcatcaactaaattaaagaggccaaagagcagcaccctgaatgtcagtgaccaaagtagtgtccataaaaggatcc

SEQ ID NO: 390947 - DNA, 508 bp, Homo sapiens
tgctggcctcaagcaatcctcctgcctcagcctcccaaaatattgggattacaggtgtgagccatcatacctgatggactatgttatatatttaaagcatattccatttctaaagatttgttctatagttgtacaagtgcacaaagacatgcacaaaaatgtttacaatattatttgtaatagaacactgggaaaacctaaatatccatcagtagaggattggttaatttgtgataggtgcatccatccacacaatgaaatgctttataaaaaaagatgtatgcggatagagaaaaatctttgagtaatatatgaaaaaataatgtacagtgaccctacctgtgtaagatgtatgtattatgtgtgcttgtgtgtttgtgtacatgtagaaaaaaattagagtatatgaaaggaagtgttactttaagtttaccaatgtggtagctttattacaagttgctttcagatttatattgcatagctaataggataccttgggattaaaaag

SEQ ID NO: 390948 - DNA, 348 bp, Homo sapiens
atgtaactttcacttttgatgaacatttattttgtaacattgttttgactgaatttccctgatttctagtaaggttaatcatctttttatgtatctgtacttcttttgttaactacttaataaattttgtcattttctaaaggacaatgtatctttttcttctgaatctttaacaattctttatagtcgatgttaatattatacaagccataattttctgcaaattcatcacttatttatcttttactacataaagtatttaaatatttatttagtcaaagataaataagtgattgttccccgctcaagtgatgttccccgctaagtgatgtcccgctaagtgattga

SEQ ID NO: 390949 - DNA, 889 bp, Homo sapiens
actgtaggggtggagtttccccgtaatctcccatcattccagcatttgacatccacaaacattatttagagcgtgaaatggagagtcctaaacagctttcggatctcaagactttaaatgagctgctcgtgtttatttccccgttcttgctgtggggttttgggcagtgcgtggaagacagttgcctcctacctggtgggcagacgagtgggaaatggtgtttggttgtttcttttttttttttttttttttttgggggagagggagagctctctccactctctgtgtctcccccagagggtgtggatgtcgcaagggcctcccaccttgggcctccacgtgcaacctcccaacctcccgcgggatcccccgcggcctatagagcctctcccgaagtgtggctgtgggattggcaatttgtgtgcggccaaccaacgcaaagaggtataattttgggggttttttagagatagaaaagatgggggagtcccgggccaagtgtgtggcgtccgagcgcgggggtcctgagaaaactctctgtgcaccttggggatgtgtactcccgcctggcctttggaaccttccccaaaagggtgttggggcaatttgtgccggggggtgtgatcgcccccggtgtgccccaaggtgtggggtgttctggccgtttaaatcggcagtgtgcgcacgcttgagggagcgggggggaccccaatgtgggggccagtgatgtgacccccactattctcaagggggaaaacttgcgctgtgtaaagaaagaagcgttcccagatctaaagaaatctcgggggtgggggacacaacaacggcacaaagcggcactatcaacttttttatttttcccccctttctgtgggctcctcctataaag

SEQ ID NO: 390950 - DNA, 790 bp, Homo sapiens
aattagtctagtgggataccaggccctgagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcaggtcaggagttccagaccagtctggccaacatggcgaaacctcgtctctactaaaaaaaaaaaaaaaaaaaaaaatacaaaaattagccgggcgtggtggcacgcccctgtaatcccaggactcgggaggctgagcacaattatcagatccgtaaacccccagaaactctgggctagaacttcataagggcacaaaacggggattggcacctgatcaccgtcctttatcccaccactagcaatttaagccttcctgaagaacagcaagaacttcgtgaaatggtggtccacagtttaccaagccagtgcgctacattgggcacacagccacggaaacgaacctctaaacggcagctccgacggctatccgggtggaacacccacacgctggagagacgaccacacccagagccccagttcaccctggcaggaagccacacacatgaaccacaccgacagcactggacggaaacctgggccacgggggacagggaccgaagcgctagaacgctctaggtcggaaagaaccccggacccgc

SEQ ID NO: 390951 - DNA, 321 bp, Homo sapiens
gcttaagtcttagagcctggtgatgatgagatgtgtggggtgagaaagacgggggagaaaagggtgacaagatttctgtgctggataactggataaatagtggatccactgggataggaggtggaaagtaaagctggtttgggagctcagtatacagttaaggatctagaaatcaaatagctttagtcttgaagctttaggtcctaaggctatatatacatggaattcaagctatagtactgctaaagacacctaaatctttagctccctgctaaactccagaacctcctatcaagctgctttctggatgtgtctccttta

SEQ ID NO: 390952 - DNA, 390 bp, Homo sapiens
ctattaagatttttctgagtcatttttttaataacctttcatttctagatgagcaacacaagaaaaggcaatgcagtcatttagataaaacacaaactgcctgccagggatcctgggtttgttccaattctcctcttaggcaaatcttttatctccctttgatatagaccagggttctaggttctatagtgcactaaactaatgaaaagaggttgtctttttctcaaatgttgtgacatagaatttagatttgaaattatagaattacagacagtaaagcatcctatattatgtaatccaactttttaagcaaagtaggaattccaattcagaattcctttctgtctcattcagcctctatgcaaatgcatccagacatatgaaattcac

SEQ ID NO: 390953 - DNA, 310 bp, Homo sapiens
aagttacataggttcctaaaattcatccccatatggtacctatttaaatcgtagataagttttaattgaattttagaaatgaaacctgtcatggagatcctgttgcaagctcaaagagctacattaaatgggtttagaaaaacagcacctctaatatctctgatgtggaggttccatttattagagattagtaggttttctctccccggtcacagaatttattggataatatagtggtttcatttttgacattctttgaaagattatgtttttatatatagtaaatggtcatgccttttcttactagata

SEQ ID NO: 390954 - DNA, 743 bp, Homo sapiens
ggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaagcaagtgctggaccgagtcttctcctcctcgcagcccaacctgtgctgctcgtcgccggagcccctggagcccggcggcgccggcagagccgagcaggggtccacgctacgccgccggatccgcgagcatttgctccccgccgtaaaggggcccgcggcggcctcgggagcagcgggagggacgcctcctggcggacgctcccccgactcagctccttcctcttcctccgcctcatcctccctgtcctcctcgccccagcctcccccgaggggggaccgcgcccgagatgagggtgcacggcgtcagggccccggggcgcacttgtgccaccagaagagctcctctctgccgggcaccgcctgcctggagcagctgctggagccgccgcctcctcccgcagagccggcgcggagtcccgcggagtctcgggccccggagacgggcgaggagcacggcagcagccagaaaataattaaacactgctggaaaccagtaatgcagaagtgcccttggctgatcccggactgtaccaggctggacattacatttacgaac

SEQ ID NO: 390955 - DNA, 334 bp, Homo sapiens
tgggaggccgaggtgggcggatcacctgaggtcaggagtttgagaccatcctgaccaacatggtgaaaaccagtctctactaaaaatacaaaaattagctggcctgtgatggcttgtgcctttagtcccagctactgaggaggctgaggtgggaaatcgcttgaccctgggaggtggagattgcagtgagcccacatcgcaccattgcactccagtctgggccacagagggagagcctgtctcaagaaaagaaaagccccgtagtttatcataatgtctgtactgggatatggctgatgctatgcatttctgtaaagtagctttaaaatatttt

SEQ ID NO: 390956 - DNA, 433 bp, Homo sapiens
acccacagcagactcttgcactctgttttctgattgcctgagttgggacccagcaggggtttcagacacgtaatctcggtcacactaaagtccagccttatgacgttttataattggccagaccttgaaacttgcctgtggaaaggcccaggggatttttaacatcggggatgaaggttgaggtttataaacctctttttaaaataaggaaacctggaaatggaggattaaaatgtaaaataattctgttcttttataaagaataagtgctataacaagagtttgaatcaggcccaaaacactacagacattctagaaatacaaaacagaaatatatacatatttggaaatgttgtaagagaggtcaaccgatgtgtgaagggggcaatttagatactgaatgttcgtaaacccaagtgagaaaatgagaaag

SEQ ID NO: 390957 - DNA, 1182 bp, Homo sapiens
  misc_feature (171)..(171): n is a, c, g, or t
  misc_feature (175)..(175): n is a, c, g, or t
  misc_feature (189)..(189): n is a, c, g, or t
  misc_feature (194)..(194): n is a, c, g, or t
  misc_feature (197)..(197): n is a, c, g, or t
  misc_feature (204)..(205): n is a, c, g, or t
  misc_feature (209)..(209): n is a, c, g, or t
  misc_feature (212)..(212): n is a, c, g, or t
  misc_feature (219)..(219): n is a, c, g, or t
  misc_feature (223)..(224): n is a, c, g, or t
tactcgtgtgttacagtgtgcccccagatgttctcccaattgcgtggcgttcactgcagctgtaacggtccctgcgtgcatttatgcgctctttggaccctgtgaacacaccgggatactggtaatcttgccccctatggagtacttatggcgctcccctgtgtttatttntttnggtataaacccttnataancantttaacnnacanaanagttcanagannaagatcagaaagaatacttgcttcatatgtcccaaaagagaaaaataaaggggacaatgccaacatgctcaacaataaaggcttctttttcttatttttgtaataccaaatacaagcaaaggatacacatacttaaaacagagctcaggagcagacacgcagtcctggaaacccttcaataaaagcaaagcaggagtttgttttttcttgtctatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390958 - DNA, 786 bp, Homo sapiens
  misc_feature (15)..(15): n is a, c, g, or t
tggcatagctgttcnagaggatcccggtgttccctttgtctatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390959 - DNA, 637 bp, Homo sapiens
gggctgcaggaattcggcacgagggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttatta

SEQ ID NO: 390960 - DNA, 694 bp, Homo sapiens
ggacatcatccgatccaaagatatgcatgatgactcagaaagcacaaaggggaccacaaaagtctgtccgctggcatgccatctcgtcacagtccgtcataaaacacttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390961 - DNA, 326 bp, Homo sapiens
  misc_feature (39)..(39): n is a, c, g, or t
accgagtcgagaagccaaagaccaggaccccccccgacncccagcgctcggcgccccactttccctttgcctttcactggacttggcgtcactgtaacctttagtctgggtttgggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttatta

SEQ ID NO: 390962 - DNA, 476 bp, Homo sapiens
atgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaattta

SEQ ID NO: 390963 - DNA, 5712 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390964 - DNA, 5745 bp, Homo sapiens
  misc_feature (5462)..(5462): n is a, c, g, or t
  misc_feature (5479)..(5479): n is a, c, g, or t
  misc_feature (5500)..(5500): n is a, c, g, or t
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggttgttccttttttgatggggtgtgggggtatagtactcagcttatgccctaaaataacatgtataaaaacccctgaagtattgtgtgggtgtgtacgtgtgagtgtgtgttggtatacgtctggcaattaaagcttggtcttctggaacttagtgaattcttttctctttttcctccagaagtattggttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgcttgatttatcttttagacttcatttggcagctctaaaactcccagtcttccttgattttagtccttaatcttttatgttctgagcaggaagggtaaacagacaggaacctggttcactggtattaactagtcccatgggctgagaccggggcaatctctnttcttcatactggcaangttgctagatactgatcgaancaggttggggttctgagtacctaacagggtggatctggggtggacaggagttaggtgggtgaccctttttagaggggtcctataaagaaggggggaggaccgatttgtgcgcgcgggtaatgacctggaagcggtggggggggaaaaatcacctcgttctgaaaaacttcgttgggtcggggtgcgcttgttgttttgtgaaaaaaagcgcctctgttgtgtggctatatatgtctagatgtggc

SEQ ID NO: 390965 - DNA, 5670 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctaggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390966 - DNA, 5682 bp, Homo sapiens
gtacggtttgcgagaagacgacagaaggggaggatgaggcaccattccaggagaaagattccggcagcgatgaagatttcctaatggaagatgatgacgatagtgactatggcagttcgaaaaagaaaaacaaaaagatggttaagaagtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390967 - DNA, 5285 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggttgttccttttttgatggggtgtgggggtatagtactcagcttatgccctaaaataacatgtataaaaacccctgaagtattgtgtgggtgtgtacgtgtgagtgtgtgttggtatacgtctggcaattaaagcttggtcttctggaacttagtgaattcttttctctttttcctccagaagtattggttacaagatttgtaaataagagctctacttagtttgtttaccatgaacatgttgcagagcacagccaagttcttagaattggtggcttggttaatctttaaacttattttgccctttctcccagtttcttg

SEQ ID NO: 390968 - DNA, 5747 bp, Homo sapiens
  misc_feature (5464)..(5464): n is a, c, g, or t
  misc_feature (5481)..(5481): n is a, c, g, or t
  misc_feature (5502)..(5502): n is a, c, g, or t
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggttgttccttttttgatggggtgtgggggtatagtactcagcttatgccctaaaataacatgtataaaaacccctgaagtattgtgtgggtgtgtacgtgtgagtgtgtgttggtatacgtctggcaattaaagcttggtcttctggaacttagtgaattcttttctcttttgcatcccaggaagttcttgggtaccacgatggtaaataaagagctctattagttgtctaccctgcaccttgttgcgcaaaccttatgcatctaattcctacaaggttaaagaaaggcttttagacttgccaggttaagcaacagccaagttctcagtaattgtttgcttgatttatcttttagacttcatttggcagctctaaaactcccagtcttccttgattttagtccttaatcttttatgttctgagcaggaagggtaaacagacaggaacctggttcactggtattaactagtcccatgggctgagaccggggcaatctctnttcttcatactggcaangttgctagatactgatcgaancaggttggggttctgagtacctaacagggtggatctggggtggacaggagttaggtgggtgaccctttttagaggggtcctataaagaaggggggaggaccgatttgtgcgcgcgggtaatgacctggaagcggtggggggggaaaaatcacctcgttctgaaaaacttcgttgggtcggggtgcgcttgttgttttgtgaaaaaaagcgcctctgttgtgtggctatatatgtctagatgtggc

SEQ ID NO: 390969 - DNA, 5113 bp, Homo sapiens
  misc_feature (4985)..(4985): n is a, c, g, or t
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggggggcccttttgggggggngggggtaagaaaacaagtatttccctaaataaattgttaaaccctgtaatttgtggggttgacggtacaaggtgtgtaacatcggacaaaagttgatcgaaaacaacttctttccacaaatttacatc

SEQ ID NO: 390970 - DNA, 5337 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggttgttccttttttgatggggtgtgggggtatagtactcagcttatgccctaaaataacatgtataaaaacccctgaagtattgtgtgggtgtgtacgtgtgagtgtgtgttggtatacgtctggcaattaaagcttggtcttctggaacttagtgaattcttttctcttttgcccaggctggattgcagtggtgcgaccttggctcactgaaacctccgcctcccgggttcaagcaattctcctgcctcagcctcacaagtagctgggactacaggcatgcgccaacatgctctgctattatatattttatttcccagtagagacaggtttcaccctgttggcaggctgtcttgactcttggctcattgat

SEQ ID NO: 390971 - DNA, 5367 bp, Homo sapiens
  misc_feature (36)..(36): n is a, c, g, or t
  misc_feature (38)..(38): n is a, c, g, or t
tagcaggagcttatcgctgggggggaactggaaagnantcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390972 - DNA, 5504 bp, Homo sapiens
tgcgtgtgcaggtgactctagagctcccccgctatttacaactatctagaaggtgattaaaagaccttgaaatccatgacgcaggaatgaatagcgtcatgtagagcctagttacgcatttactaaacgcagacgaaaatggaaagattaattgggagtggtaggatgaaacaattcacaggaagatcgtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390973 - DNA, 5449 bp, Homo sapiens
tgctccctctcgactaggcagactgaagcagtcagtagtactttgactagaagcaataattccttaattgcctgttgccctgctgccaagattctctctctgttctttgctacagctattaatgccaatcaacttaaggccatactgtgttaatgaaaatctagagtctctagatggataacgatcgagaaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390974 - DNA, 5390 bp, Homo sapiens
gatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcagaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390975 - DNA, 5267 bp, Homo sapiens
  misc_feature (144)..(144): n is a, c, g, or t
cagctccagcttcagtgtttatccaaatactaaagaaaaaagtagaggttgtctttttcgatggcaaatcggacccttgcaggctgagggagagaaagctacatcacacacagaggtggggtgctcccgaggggctgtgggtcntaggtggaccgcctgcccggcttgcacgcgctcctcgtgttaggacccggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390976 - DNA, 5148 bp, Homo sapiens
tcaaagcatcactccccgatggcagctggcgacagcggtggcgagaggatgaacaacaagttcgacgctttgaaagatgatgacatgtggggaccatgatcagaatgaagaaaacagctaacaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390977 - DNA, 4433 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgggaaggcatttagactgagatgcttaaccagacacgttatcgctttt

SEQ ID NO: 390978 - DNA, 4111 bp, Homo sapiens
taaaattcgcggccgcgtcgacagtatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390979 - DNA, 3751 bp, Homo sapiens
ataaaagaatgtcaattctattatgctataaaagcagagcatggttaatgggacctgaatgtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390980 - DNA, 3514 bp, Homo sapiens
  misc_feature (19)..(19): n is a, c, g, or t
  misc_feature (26)..(26): n is a, c, g, or t
atcaatggctggtcccccncgagtantggatatcgtcgtccaggcctcggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390981 - DNA, 3504 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgccgttaacttttgaaggtgcgttgtttggttt

SEQ ID NO: 390982 - DNA, 2893 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttcc

SEQ ID NO: 390983 - DNA, 2530 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaattta

SEQ ID NO: 390984 - DNA, 2450 bp, Homo sapiens
ctatacaatcagctcggtacccaggtctcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390985 - DNA, 988 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttatta

SEQ ID NO: 390986 - DNA, 1404 bp, Homo sapiens
  misc_feature (1227)..(1227): n is a, c, g, or t
  misc_feature (1231)..(1231): n is a, c, g, or t
  misc_feature (1243)..(1243): n is a, c, g, or t
  misc_feature (1280)..(1280): n is a, c, g, or t
  misc_feature (1298)..(1298): n is a, c, g, or t
  misc_feature (1368)..(1368): n is a, c, g, or t
  misc_feature (1400)..(1400): n is a, c, g, or t
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaatttttttttttttttttttttttttttttttttttttttttttttttttttttttttttttttatgattacacncatntatttaacagcncagttttacacagaatgctaagagcacttttcttcanattttacagaagggcttnaaacatacagactattcgtaatcatacaatagcacatccaaatctaactcctaaatagatgatgcattanaatttgtttagaatttggcttaatggcattcngggg

SEQ ID NO: 390987 - DNA, 1525 bp, Homo sapiens
tcgtgatagctgactctagaggatacacctctgtccacagaaaaggcgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390988 - DNA, 1383 bp, Homo sapiens
atttcttcactcatatcctccaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390989 - DNA, 1001 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccattccaggagaaagattccggcagcgatgaagatttcctacatggaagatgatgacgatagtgactatggcagttcgaaaaagaaaaacaaaaagatggttaagaagtccaaacccctggaaagaagatgcagcaacgaagg

SEQ ID NO: 390990 - DNA, 1393 bp, Homo sapiens
ctatgactattataagaaatgtaagatttggataagtcataatcacagatcagaaactgcagacattgaggcctggatggccgtttagagagaaagagttaacatttcagtggagacctttcctatcttgtatttcctacagtctcctcctatcttcagatgcagtgttctggcagcacctcaagctcactgtcaccaaatgggattcaacgtctttcctcccaaacatgctctacctcaccatgtcgatagatgtacagtcgccccactactggcttaaattctaaattactgaaaaccatgcaacaggcaaaagtgtgagacaaagggaaacaccgggttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390991 - DNA, 1557 bp, Homo sapiens
ggattccttgtcttcaaatggcaggtggagctggttgtctaattgaagccgaattgtttggtggttcttataaaaaggtggtattcaaaaacgtaagtggattattaccagtacaagcacccgtaatactcccattctttcacgtctaggccaactggtcttcaggctgtagtctgcgctagtggtcatttgcttataatcattgtttttcctttcttgacttcctccaaagtggtaaagtgaaattcctcatgtggtcctgtctgccctccctctttttctagtttccccctcctaccccgtccaactctcaggccagggctacagaggatggaaggctattgccccctatcattgtgcactcttattacagagccaaggattgtcaccagtgaagaggtcattattcgagacagccctgttctccctgtcaccctgcagtgtaacctcacctccagctctcacacccttacatacagctactagacaaagggaaacaccgggttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390992 - DNA, 1097 bp, Homo sapiens
gtgatcagaatatgtaatgaaggtctgtgtctgctggtaggaggttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390993 - DNA, 895 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaaaaaaaacaaaaaacaaaaaaccccggaggccctaaatagccggggggcgggacaaaagggcgtacgagaaggggccaagtgggccaaacggggtccccggagaccccagtttcctgggcaccaaggggaaaaactccggcggaggaaccccaaaaagagagagcgcgcgaataagagtgcaggaaaaccgccgggaacccgggataa

SEQ ID NO: 390994 - DNA, 1278 bp, Homo sapiens
  misc_feature (1143)..(1143): n is a, c, g, or t
  misc_feature (1160)..(1160): n is a, c, g, or t
ctatgactattataagaaatgtaagatttggataagtcataatcacagatcagaaactgcagacattgaggcctggatggccgtttagagagaaagagttaacatttcagtggagacctttcctatcttgtatttcctacagtctcctcctatcttcagatgcagtgttctggcagcacctcaagctcactgtcaccaaatgggattcaacgtctttcctcccaaacatgctctacctcaccatgtcgatagatgtacagtcgccccactactggcttaaattctaaattactgaaaaccatgcaacaggcaaaagtgtgagacaaagggaaacaccgggttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggttgttccttttttgatggggtgtgggggtatagtactcagcttatgccctaaaataacatgtataaaaacccctgaagtattgtgtgggtgtgtacgtgtgagtgtgtgttggtatacgtctggcaattaaagcttggtcttctggaacttagtgaattcttttctctttttcctccagaagtattggttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgcttgatttatcttttagacttcatttggcagctctaaaactcccagtcttccttgattttagtccttaatcttttatgttctgagcaggaagggtaaacagacaggaacctggttcactggtattaactagtcccatgggctgagaccggggcaatctctnttcttcatactggcaangttgctagatactgatcggacaccaaagggttggggcatatcttgcaaaacctttaaagttgctgaatttgccgctgggtctcagggaagtcacagtttgaatgttacccttttttta

SEQ ID NO: 390995 - DNA, 939 bp, Homo sapiens
gtacggtttgcgagaagacgacagaaggggaggatgaggcaccattccaggagaaagattccggcagcgatgaagatttcctaatggaagatgatgacgatagtgactatggcagttcgaaaaagaaaaacaaaaagatggttaagaagtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgtaggactcgattgcaagacaaaggatgtgtagacgaccgagagcaagcgatgatctctgcactccaggcgaggaggatagtgaagatgaaaaagaagatcataaaaatgtgcgccaacaacggcaggcggcatctaaagcagcttctaaacagagagagatgctcatggaagatgtgggcagtgaggaagaacaagtacacgacggtacggatgcagggcagccattccaggagaaagattccggcagcgatgaagatttcctacatggaagatgatgacgatagtgactatggcagttctaatctatgcaagatacggagttctcccaaacgacatacatggaccgtgaacctcaattaacttggcccaacgcaagaggaccatcatcatgcctgtgatcgaggatgctcgagacccacaggaaataccggatgctcatcgcaatggtggatgtgatcttgtgctgatgtggccagccagaacagacccggattgtggcctgaatgcccaactcctgtaaagggggggagacatggggaatcccatagggcatgcttgatccacggcca

SEQ ID NO: 390996 - DNA, 766 bp, Homo sapiens
  misc_feature (608)..(608): n is a, c, g, or t
aaggctaggtgcgaggccgggtggcgggggagcggggggctcgtctgttccaggagccctgaaccaaagagcagcggagtttgagaagccagcagctcggggttcggcagcagcggtcccatctctccttctgcctcactctgggcctcttctttctactgtacatttccacctctctaggcctctgctctcactgtccctctctgtctgtctctcagcctttatctctgggtttgatcccccactccaggctctgggccccttcttcccccttccctcaaacctggctgctataggcaggaaggaaaccctggaacacatgtggatatatatacgagccccacggggaggggggagagcaccacgcgacggcgggaggagttgatggcggctgtctctctctctctcccgcaaggacccaggctgtggatcacggggcctgccagcttgagtgtagagggaggggggactctacccttctcagccccaccagcccccctctgcccaaccacaattttcccttcctccgccttcctctccctctcctgtttacactccccaaatgcgcacaggctgttatcatgggtcctgagtcatcccacacacangctgccccagcgtccctgcccccagctggcgcagggcccgccccatggagccccctgccgcctgggctaatgggagccagatggccgctggtgactcagacacgggcctgtgggaaccaggcgtcccgcttccatgccccaaaaccggtccttgtccc

SEQ ID NO: 390997 - DNA, 5597 bp, Homo sapiens
  misc_feature (5462)..(5462): n is a, c, g, or t
  misc_feature (5479)..(5479): n is a, c, g, or t
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggttgttccttttttgatggggtgtgggggtatagtactcagcttatgccctaaaataacatgtataaaaacccctgaagtattgtgtgggtgtgtacgtgtgagtgtgtgttggtatacgtctggcaattaaagcttggtcttctggaacttagtgaattcttttctctttttcctccagaagtattggttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgcttgatttatcttttagacttcatttggcagctctaaaactcccagtcttccttgattttagtccttaatcttttatgttctgagcaggaagggtaaacagacaggaacctggttcactggtattaactagtcccatgggctgagaccggggcaatctctnttcttcatactggcaangttgctagatactgatcggacaccaaagggttggggcatatcttgcaaaacctttaaagttgctgaatttgccgctgggtctcagggaagtcacagtttgaatgttacccttttttta

SEQ ID NO: 390998 - DNA, 5658 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccataaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 390999 - DNA, 5274 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttactatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 391000 - DNA, 5226 bp, Homo sapiens
gcggccgcctactactactactactgctcgaattcaagcttctaacgatgtacggggtcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 391001 - DNA, 5144 bp, Homo sapiens
tacgcgctgttcactatcttcatcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 391002 - DNA, 4997 bp, Homo sapiens
cccaccccatgaggaaagatgccccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcggcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggattttttggtatgcagatacatacagagactgggatatgtaaaaattaagtatcacaaaagaccatcacacgattctaccaatgcatgttgcatctgtaattcacgaacatggtcaacaaaatcatgttcacttcaaccccatttcatttaaattaaagaaaaaaaccttttaaataaagtggttacattcaaactttaacttccttagtaccatgctgcagatttcagcactgttaaggtattgcaagaatgcccaaccctctggtgtctgatcatgtatctagcaacattgcagtatgaagaaaagagatgccccggtctcagcccatggactagttaatacagtgaagcaggttcctgtcttttacccttcctgctcagaacataaaagattaaggactaaaatcaaggaagactgggagttttagagctggcaaaatgaagtctaaaagataaatcaaggcaaacaattactgagaacttggctgttgcttaacctggcaagtctaaaagcctttctttaaccttgtaggaattagatgcataaggtttgctgcaacatgttcatggtaaacaaactaagtagagctcttatttacaaatcttgtaacaaatacttctggaggaaaaagagaaaagaatcactaagtccagaagacaagcttaattgccagacgtatacaacacacatcacacgtaacaccacacatattcggggtttatactgtattttagggctagctgagtactatac

SEQ ID NO: 391003 - DNA, 1949 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactca

SEQ ID NO: 391004 - DNA, 3034 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgttacctgaccttatttgagggtatgggctttcttttttatttcatcacttgttatctcaaa

SEQ ID NO: 391005 - DNA, 1248 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttttttttttttttttttttaaagcaaaccattgtatgtgtaagtgtttaagttacctttttgtctattggtctctttgccagccctcccctttcccaatgaaagccatgtcaaatt

SEQ ID NO: 391006 - DNA, 1150 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtccaagatagattctgagttcatctttaaatttgcccacagcacctctaaatcccttgtaaatttacctgttagtcaaagaggacagctctttgacactaggaaaaaccttgtagagagagtaaaatttacaccatagtaggctaaggcagcaccattagaagcgtcagctcacaccatactaaaatccaacattactgactctcaaccgattgtcatcttcacctt

SEQ ID NO: 391007 - DNA, 755 bp, Homo sapiens
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaagggagtagagagaaaaaaaaaaggtcgtatcga

SEQ ID NO: 391008 - DNA, 925 bp, Homo sapiens
  misc_feature (748)..(748): n is a, c, g, or t
  misc_feature (752)..(752): n is a, c, g, or t
  misc_feature (764)..(764): n is a, c, g, or t
  misc_feature (801)..(801): n is a, c, g, or t
  misc_feature (819)..(819): n is a, c, g, or t
  misc_feature (889)..(889): n is a, c, g, or t
  misc_feature (921)..(921): n is a, c, g, or t
cggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaaaaaaaagtggccgctcgaattttttttttttttttttttttttttttttatgattacacncatntatttaacagcncagttttacacagaatgctaagagcacttttcttcanattttacagaagggcttnaaacatacagactattcgtaatcatacaatagcacatccaaatctaactcctaaatagatgatgcattanaatttgtttagaatttggcttaatggcattcngggg

SEQ ID NO: 391009 - DNA, 507 bp, Homo sapiens
atgtacatatatgtgctagggtctgaaatgtttgtgttcccctaaaacgtgtatcttgaaatcctaaccccgaaggtgatggcagtaggaggtaaggcctttagaaggtgattaggtcatgagggtggaggctctgagtgggattagtgcccttacatggaggcctcaaagagcttcctcatcccttccactatgggaggacaccacaagaaaacagaggtccatgaatcaggaagcagggcctccccagacactgaatcttctggtgccttgatcttggacttccaacatccagaactgtgagaagtaaatttctcacagaagctacccaggctatgctattttgttatagtagcccaaatggactaggccaacatgtgtgtgtgtgtgtatagtacatgtgtgtggcatgtgtgcagtgcactgtgtggtaaaagtatgtgtgcactatatgtgtgtgtggggtacgtgtgtgcatacaatgtgtgtgtgccacatgcatgcggc

SEQ ID NO: 391010 - DNA, 227 bp, Homo sapiens
caagagcaaaactccatcccccccgccaaaaaaaagtttaaaactgactctagtaagtcagtaactcctctaaaggaagccctggaactttggagagatttcactaattaccaattcaccaatatatagcccctgaacattgtatctcgaagtcttctaaatctgataaattacgtatgtgtggtgttctaccaccaagatcacaaatgggtacttctgattgcatc

SEQ ID NO: 391011 - DNA, 247 bp, Homo sapiens
tagcgggattacaagcgtcagttactgcacctggcctctttctcaggtgcaatcatagtgcactacagcctcaaactcctggcctcaagtgattgttctgcctcagcctcacaagtagctgggactgcagacatgtgcaactgcatccagctagaattctctttttatttatttttttttttgagatggagttttactcttgttgcctaagctggagtgcaatggcgtgatctcggctcactgtaac

SEQ ID NO: 391012 - DNA, 120 bp, Homo sapiens
ggtctaatgagcagttccagatgagggaaccaaatgcccatgggaagagcttggacttagcccagtaaacacaagagaggtccttaagtttatgtgggctgatgaaagtggtgttttaca

SEQ ID NO: 391013 - DNA, 609 bp, Homo sapiens
atcttagaagctgactctcacagggtggaaattgagggaaattgctatacatgtgtgctgtaagtgcctcatgatgtggcagtctgaaatatgagtcatgccattcgtcctacataacctgattcttattccctgcttcttctgtgcatcatgcagtattttcagggtctgaacagtgtttatgtctgtgggtcccctacgtgcctattagtgcagcaaagacttggactcaggagttagacttcctgggttcccagtccatttctgccactttctcagttatgtcctcttgggaaatatacttactctctctgcgcttccgttttctcatctttaaaatgggagatagaatacctacctcacaggtaagcgtatttgaggattcaataagataatacatgtaagcactaaaaacagtgcgtggcatgtaatactagcacccaataaagattagctcttaggatcatcatcgttatgtcttacacataggaagccatcattaggtgcttggctttcatcaattttggtctgactctacacgtctattgaagtttgtaaaaattaaacattgggcctttgaaatgttctttaatatcactgtgggaaaaa

SEQ ID NO: 391014 - DNA, 335 bp, Homo sapiens
cgagctcggtacccttttccacagggtacttttctctctgcgcttccgttttctcatctttaaaatgggagatagaatacctacctcacaggtaagcgtatttgaggattcaataagataatacatgtaagcactaaaaacagtgcgtggcatgtaatactagcacccaataaagattagctcttaggatcatcatcgttatgtcttacacataggaagccatcattaggtgcttggctttcatcaattttggtctgactctacacgtctattgaagtttgtaaaaattaaacattgggcctttgaaatgttctttaatatcactgtgggaaaaa

SEQ ID NO: 391015 - DNA, 377 bp, Homo sapiens
ggcatgtggcattggaagagagaacatgccaggcaaggtgatctcttccagtctgaggttttatttgatagcttaaggactcagagttagtcaaaatgcaatgtctgaaggcacccttccttctgacaccagttgcagatttgaaggtgtttcttaagcccccactcaggtttgataattcactacaaagacttacgtaactcactgataactgttattgcacgattgtggtttatcacagggaaagaacacagattaaaatcagcctaaggaagagacacacagggcagagtctgggagggtttcaggtgtgaagcttcgttgtcctcaggacgctgtgttctcctgtgtgaatgtgggacaaaacacatggggtg

SEQ ID NO: 391016 - DNA, 373 bp, Homo sapiens
ctccccagtacgctgttatcactgtgtgaccgcaaacatgacgaggtgaacttatagtataaaacgtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagttta

SEQ ID NO: 391017 - DNA, 640 bp, Homo sapiens
ctcccgaaggcagggatgatattatatgcattccttgtccccaacactgatcactgtccttggcccgaggaggtgctcagtcatttctattgaattaagacagatcacctcccccagagctgatgcctgagtgaatgaaggttagcccctgaggtggttagcagggccggattaggatgcctgagaccaagcttccttcagtggcaggtggcaaattctcacacatggcccatgcacctgtacctctaaaataaaaatgtttgccatatgtgaagatgggacagattttctaatcaggacttttccaaacaacagccaagttcctcctcatagagggtgactggtggcccatagggggccttcgtgggaataagaataagaccccagtgtggcattctgccagatacatggctgggaagcagaaaagagactggattccagccccctttcacctctcagccaggccctcttgagcagggcccacctggcagtattctgtaatcctacaaactgtcctcagggtctgtgtcctccaaagaaagtttaaagcaaaatattcctccatgcactcactgtgtcctctcttctgatcttttctaccactttaactagatttaaactaatacaatggttgccgggc

SEQ ID NO: 391018 - DNA, 513 bp, Homo sapiens
ctttttactcttcattatactggatgtcatagctagagttgtaaggcaagaaaaagtaataaaagatacacagattagaaaggaagaagtggaacagtctttatttgcagatggctgcaaaaacttattagaactaaaagtatattgaacagagtttagagatacacagccagtataaaaaacaaatgtatatctacatacaaagcataaactattaaaaactgaaaaatttggctgggcacagtggctcacacttgtaatcccagcactttgggaggccaaggtgggtggattgcttcaggtcaagtttgagaccagcctggccaacacagcgaaaccccgtctctactaaaaatacaaaaaattagccaggcgttggggtgcacatctgtagcactagctgctcaggaggccgaggcaggagattggcctgaacccaggaggtagaggttgcagtgagccgagattgcgccactgcactccagcctgggtgacagagtgagactccatctc

SEQ ID NO: 391019 - DNA, 220 bp, Homo sapiens
ttggcctcccaaagtgctgggattacaggtgtgggccaccatgcctagcctccagctccttatttttagtggattaccttaatttgtagtattcctttcatacatttttctcactttaataatcacagttttaaaatatgaatactttagtagcatcgctaatactactttatataataatactttagtagtatcgctaataccactattacaaggataa

SEQ ID NO: 391020 - DNA, 591 bp, Homo sapiens
ggaggagaaagctgagaggcagctagacagggagggggtggggagagccggggccacctccccgtctggtctgtctgcctctgtcctggccagaaggaaggaggacacagacacaggcatgtaggggtgcggcagagatggggggccgtgtgtctttgagccccaaggttctcctgagctgagaccttcattacctcatgtgcttcctaaggatacaggccttgaacctgctgggggcaggccctggactcaagctccataggcagcccccctttttctagcctgggtgatgccctcccgagtccttgcttttcaaagcattttggggggacgtggtaggggcacccatcctctgctccaggagctggagatgggatttcccatttctctgacaagaattcccaagaagtgatggctgtcactgcagctccacccccatgcccatctttctttttctgttatagattgtttatgttaagtcatctttctctgggacaaagtacttagcctctcattttcatcagtaaaagcagggataataattccttcctcacagagttgttaggactgccaaattaggtcccatatgta

SEQ ID NO: 391021 - DNA, 367 bp, Homo sapiens
gagatggagtctcactctgttgcccaggctagagtgcagtggcatgccctccatctcccaggttcaagagattctcctgcctcagcctcccaagcagctgaaattacaagcgcgcaacaccatacccgactaactaatttttgtatttttagaagagacaggatttcaccatgttggccaggctggtctcgaattcctgacctcaggtgatccacctgcctcggcctcccaaagtgctgggattacaggtgtgagccactgcacacagtcaaacatgtggtttttaatctgtcaggaaaaaagttccagaaaagtgatgtcattttataaatctcagatttaataaggataaaaaattaggagacag

SEQ ID NO: 391022 - DNA, 489 bp, Homo sapiens
cacatcaaaaagttaattccccatgatgaagcaggctttattcctgggatgcaaggttggttcaacatacgcacatcaataaatgtgatttaccacgtgaacagaatttaaaacatacgatcatcttaatagatgcacagaaagcttttggtaaaatccaacatctcttcatgataaaaaacctcaaactaggcatcaaaagaacatacctcaaaatcataagagccatctatgacagactcatagccagcatcatactaaatgggcaaaagctggaagcattctccttgaaaacattaaaagaaaggatgtccactctcaccacgcctattcaacatagtactgaaggtcctagccagagtagtcaggcaggagaaggaaataaaaggcatccagataggaagagtagaagtcaaattatctcttttcattgacagtatgattctatacttggaaaaccctaaagcctccaccaaaaggctcctagac

SEQ ID NO: 391023 - DNA, 372 bp, Homo sapiens
attctccctaccttgcctaggtttccccttttctctttcagtctattgagacgcttcccacggctcagctgagttggcctcacccaaccaattcaggacaaccccacctggaaatgatttttcctctagaattctataagcgctcatttttatctacaattatttaacttagcaaatgtttactgaatatggatatgtatatatatgccaggtaccatgctaggcaattagagataaatataagattcagtctttgctgccagggagctcaatttagtgaaagagagataagggaaatgaataattctaacaccgtgataagtacattgtgtgagagttcttgtgacagtggtaggtgcgggaggggaatgg

SEQ ID NO: 391024 - DNA, 788 bp, Homo sapiens
agtggcagtggtagtctaatccagagctccaagccatttaaagctcattcacatttgcatttgtctatgaagttcagatgttgctcactagggcttcaccccatagggcctgctggtgcttccaatgagacacccactctctcaacaggaaggaccatctggtctctgctgtgttgctggggccacttgcatggcttaggaatcactttgattgttggcccctccctactgtgagctccttgagtgccttgtctgcacctggggcatctgggaaggcccagtcccagcccaggggatccctcggaggcccctgaatgagtgatcccacaagtgcagattcaactctggtttggagggtaaagggatctgggagttgggttgccagtgtggagactgaattcaaagaaggattgtgaaaggtattaattgttattattacgacatttaaacagtgtttacaagctcagagaggactttactgtaggctatttgacatgtatggttcactatttcataagggaggaagctgaatgaaaagtagcttaagagccgggcgcggtggctcacgactgtaatcccagcactttgggaggctgaggcgggcagatcacgaggtcaagagatcgagaccatcctgcccaacatggtgaaaccgtgtctctactaaaaatacaaaacttagcggggcgtggtagtgcctgcctgtagtcccagatactctggaggctaaggaaggagaatcgcttaaacgcgggagtcggatgttgccttgagccgatatcatgcca

SEQ ID NO: 391025 - DNA, 391 bp, Homo sapiens
agtaacctctaatctacttttggtctctgtagatttgcctattatggacatttgcatagatgctatcatatcatatggtacaatatgatgaaattgtccatttgtgtcccacctctttcacttacgataatgttttcaaagttcatccacattgtagcatgtatcagtactttattctttttaattgccaagtaagaattcatcatatggacataccacattttgtttatccattcatccatttatggatgtttgggttttgtccactttggtgctattatgactaatgctgttatgagcatttgtgcacaagtaccctcttaaactttgtgcccaaagtgagtgtctcatttacctcactgtagttccagccttgttactttgacgacgc

SEQ ID NO: 391026 - DNA, 421 bp, Homo sapiens
aatcccccatcatccatggttttgctttctgcaggttcagtcacctacagtccaactgcagtctgaaaatattaagtggaaaattctagaaatgatttctaagttaaaatgagtttttaaaaacgttttaaattagttttcagtagtagtctaacactacatcacagtgcctaccttattcacctcacttcatcacatcatggaggcattttctcacatcacaataagggtgaatgcggtatattttgagaaagagactagagtcacataacctgtcacagtatattgttatatttgttctattattgttacttattgtgcctaattcgtaaattaagctttatcataggtatgtacgtataggaaaaatatagcatacacagggttcaatagtggtttcagccatccactgagattgtct

SEQ ID NO: 391027 - DNA, 366 bp, Homo sapiens
caccttgatattcatcctattaacactgcttttcattgttacaaaactctttttgtgtttggttttttcattttttaaaaaaaacagacccaaagcttacaaaacttcttttgttttgatattcactctaattagtctactcacatgtgaacccattccagttagactttggctctaaactctactcctaccttaccaaaaaagctctggtcaaggtcatcaatttcttccatgttctaaatatttaaagtttttacatttttgtctttgatttatctgtatattatttttgtatttttgtggggataaattttaacttttttccatagaaacaaccaattgtatgagcaggttttgctgtgtctt

SEQ ID NO: 391028 - DNA, 394 bp, Homo sapiens
ctcctggcagtagggttcatgtgattgaaagatacgaaaacggaggctcaggcatgtaagaaatattccagaatagaggtagggcacgctggctcatgcctgtaatcccagcttggctctgtgccacatgggagcagctccagagtgactttcaacttgtttctgcagggttttgtttggagcatgaggactgtcttctgttgatttgctttttaagcaacagtaaattcattcctggctttatctattgagccccattttgcacaattctctggcccaaatttgcatcagtgagggatttcgggcaggtccagggctctccgcaacatccatctgcttgccctccattgccagggtgtgtcctggaggtgtgtcctagcccatctttctgttc

SEQ ID NO: 391029 - DNA, 148 bp, Homo sapiens
agctgcctacaaggaaggtactttaaatataaaaacagaagacagtgtggtggctcatgcctgtgatctcagcactttgggagtctgaggtgggaggatctcttgaggcccaattttcgaaagcagcctgggcaacgtagacccagtt

SEQ ID NO: 391030 - DNA, 503 bp, Homo sapiens
accacaaggaggcaacttaaggtgcccagaacatagaatatatataggtcagttttccacagtggctacttgctatctttataatgttctctccgccactttcaggagccgctgtagcctacccactgaattaatgtcccgtcctgaccatccccatccatccctgagtgtcaggaagcagtaggagtctgaaactccttcccaagctcatgtagtcagagtcagaatctcagcattcctcaccctctcccaaagcagggtgtcactctttctcatgacacttcattgatctctactctttttgacatatatctaaaaaccttcctatagccatctgagcccatccttctcttggccacccactggagagatcttacttgtccctgtatccttaaagtacctgatctgagtagatgctcgtgaactaaacaaatgagttaactgataacctggtttcagtgacgctacagtaacatttctttcagctgtgcagagaccctatc

SEQ ID NO: 391031 - DNA, 478 bp, Homo sapiens
gtatacatcagttagtgcttttaaccttcccccagcaagtcaatattttcctaagatttaaagaagtagctgtttcctccaaggctttttttcttagtctctaaatcttaagttgcaaataatggaatctaagtttaaaaccatgcttcatcagaaatactctcaatgtactaatggaacacattatcattgctgattattattttctctaataccataaaacctcttgattatttctaatactcatataataaaatatattttatattggtaacatcaggtaaataagttgttatggatatcaaaagtatgaccagtacaagccagcgttttatattgcctcccaccttaaaaattacactgttacacattgatatccctgaaaacaaatgtgttaatacatatcactctgaatcattcacagtgatattactcaattaattgtttatttaattaccctatttggtaatcaaaacag

SEQ ID NO: 391032 - DNA, 290 bp, Homo sapiens
tgccgtgtgcaacctccatgaggatgttgaacctcactagctttcctgtgtgtgctgttgctctgcagttctgcagggctcagccttggccacgttaacctctcagtccccctaaattggtaactctgcatcctgttcccaacaccagaagccctaaggacaactagaaaggctgggcgagcacccaggtgcaagcatgctcacctggggcaggtgggaggtcactgtaagaacagcctgggagagctgtaatgcaccatcaaggacgggctcctgggacctgggaccca

SEQ ID NO: 391033 - DNA, 429 bp, Homo sapiens
gtgtcggaagcagacagcagccctctccagacagcagaacctgcagcaccttgatcttgaacttcccagcctccacaaatgtgagaaaatgcatttctgttctttataaattactcagtctgcaggattttgttatagcaccacaaaaagatttcaagagtcacttttagccctcaaaaattaaaatactaacacaagagcacacaaattattatttggctagtgatagcattcatcaaaaaagcattatttctttcatgttgcagtgtgcttccgcggaagcacactgcaacagaccctctgtatatttccgcattattcttgtctccttttcagaccatgatggccaatatggagattaaaatatgtcatcagtcatctctttatggtgacttccctttgcaaaccaggctgtgaccaacacatgtg

SEQ ID NO: 391034 - DNA, 727 bp, Homo sapiens
gaatgttagaacagaaggtctcaccgtggactcaagagctgacatgaagaatgtcaccaccatcctgctctccaaggactcctcatcttcaatggactcctcatcttcaacggactcctcatctacaacgggcagggtggaaactgcaacttgtgccatgatccctgcgcaagaaaagtagtaagaaattgagtggtagaaatccagtgtcctaaactcacatccagagctgtgagagtttttcacaggctggctaattcagagttttcttgcatcagaggaaaagtaagactcggaaacttggtattcgatttgcccaaaactctcattagatagagaatccatccgctaactttctatctagtattatttccataaagttagatcaatatcactcccaaaataaatccacgtggcaaccagaatcagtgcatttctcccaagtacaagaggaggtggccgagcgtggtggttcacgcctgtaatcccagcacttttggaggccgaggagggtgcatcaggaggtcaggagatggagcccatccaggccaatatggtgaaaccccggtgtctactaaaaatacaaaaaatagctgggtgtggtggcgtgtgtcccagctacttgggaggctgaggtaggagaattgcttgaaccagggagtcggaggttgcactgagccaagatcgtgccactgcactccagcctggtgacagagcaaaactccat

SEQ ID NO: 391035 - DNA, 450 bp, Homo sapiens
gcacgagccgttttcagcaaaaattttgtatttatatagattgcctataagaatatttgatagaaatgatgtattatgcactatcttcttgacagagaaaatctggtctgcagacgtagaaaaaaacacagatggatgaaaacaattctgtaatcaagatttgatgttggaggtacccaagtaaactgacagggaaagactaaattgtggaagaacttcagatacaaatttctaagtcattttatatttttgggtatttatagtccatgtaagatacctctaactttctaggtgatttaacctacataatgtatggccctccagaccgagcatgaaaacagcttatattcctgtctttgtaatgtgtatttgtcataaccaagagtgtagatcaaaattctgagaggcactatctctaacatggaaataaacaatgtaggacaatttcta

SEQ ID NO: 391036 - DNA, 379 bp, Homo sapiens
agagacgtgggcagggattctgggaggttataggaagcaactggatctacccttgagggaccatcagcttagaaccctgtcctgactatggagccattaagaagctggtatgctctgaaggaagtcaggcagtggtgttcatgctgccatcctgaaccaagcccctcggagaccattctatctcattccaagctggcaagctccttctaagtgcccaccatggggcaggtgctatggaggacaccaagatagaggaagacagggcatttgccctcctgtcatttccatatgtttagggagataggcagacaggtgactggaggtcatggcctgtccagagcttaggatgaaaagcagctttattaatagtacctacaca

SEQ ID NO: 391037 - DNA, 1046 bp, Homo sapiens
tcaaattgaaaacctttaggttgtgttcttggctcattctctcataacctggatctaagttggaaagctgtggcaccctgtttgggtgtcccatctaccctgttttctgtttctgcagatggcttgttcaagcttcattttaagcctgctctgtctacttatcttccttatatcctaatagacttctcttgtgttattacacatttctcttttgctctaatatttcattattttccagtttgtcagtaccgttatcagagggacaaggaaggaataacacaccagttgaccattttgtttctctgaaaatctgagcaatacggagatccttttattagtaaaactgaatcattactcatactacaagggctttcacttttaaaatgtaatccatcattgcttgccatttttatgaaaaccaaagttgaaaagtcttctgaatcacaggctatgtatagccacacatgcatgacttcaggctagcataaagacatgtctgctcctgagcctcttcttttaaagggcaaccacttgtataccctctggtggccactcctccttctccactccaaggcagccctggtactttcctaagtggcccctcctacagagcacttgccggcatttggcctgctgctggtgaagacgccccttactagcttcataaatgtttttctgcaagcagggatcccagacacatactttggtttctagtgtttcagttactatgttgtatttgaaattctcattccacaattaccctttagttgaagtcctgaagtacatgccatgtactccccctttatttctaccttgatcaatggcctctgcggagtgtagtgaaagacatctttttattatgatctacactttaaaaaaccaaaggctgcctgtattacattgctttggggagttgttaagactctgttttttctactgcttcacattaaacaataattttgttgaattttgaattcttaaaattctcactgacaaacattttaggtcagtgttgaggaaaatgtgtgatgcatgttagagaggtg

SEQ ID NO: 391038 - DNA, 832 bp, Homo sapiens
cttgggaatttcagtcctacccccatcctctgggaagacctggaggctggagattgagttaatgatcagtgatgttcaagtaacaaagtcttgtaagaatcccagaactctggggtttggggagctccagggctgctgaacatgtggagggtagcccacccggagagggcaaggaagcgcacttcccctcccatacacctcgccctgcatatctcttcatctggctgtcttctgtatcctttattgtattctttattacatagtaagctgggaaatgtgtttccctgaggtctgtgagccatcccagcaaattatgaaatccaaggatggggtcgtaggaaccctggtttacagctggtcagtcagacatataggtgacaacttggcacttgtatttggtatctgaaatggggggcagtcttgtgggactgaacccttaacctgaggtctgtgctaactccagttagtatcagaattgaattgaattgtgggacactcggctggtgtcattcagctggtgtcagagtattccttgacatcgcttcaatccctggtcacagaagtgtgtggagtgcaggtatagaaaaggaaaagtagggccgggtgtggtggctcacgcctgtaatcccagcactttgggaggccaaggtgggaggatcatgaggtcaggagatcaagaccatcccggctaacatggtgaaaccctgtctctactaaaaataggaaaaaattagccaggcgtggtggcaggcacctgtagtcccagctactcgggaggctgaggcaggagaatggtatgaacctgggaagcagagcttgcggtgagccgaga

SEQ ID NO: 391039 - DNA, 655 bp, Homo sapiens
ttgctggctgactcttgaggatccactctccctactgtatcctacccccatcttatttattgggcaaaactaaggcagtctgtcctgtccttttacctgccatatatccattcctctagaatagctcttttcattgtgttgtgactgtgtatttgcttggctgtaggcctcttaagagcagagatacttttctaaaattgcctttgtgtttcttatactccacacagtgcagcataatggaagacgcatcatacatgtgactgcataaacatgggggattccaagtagaagaaataggatgaaaataagtatagagataataaaggtccttgaatgttcacagagattaatcatttcgtgtggttgtaatacacagttagtgaaaggaaagagtagatgatgaggctggaaaaatagacacagaccttaatttacaaagtctgaaatgctggagtcaagaggctgccctctataccctcaagtaggcactgagtagaggagctatgaatgacttgtatgcttgaaagcagttctccacaaacgtcattctggagtggcaaacaaaatagaatgaagggtggaatctcttagaactcactgcatgtctgctagattaaagttgtataatatttcactaggatacagtaggtagaaa

SEQ ID NO: 391040 - DNA, 652 bp, Homo sapiens
cctcctgagggtaaaccgacgctactgcctactgtatcctacccccatcttatttattgggcaaaactaaggcagtctgtcctgtccttttacctgccatatatccattcctctagaatagctcttttcattgtgttgtgactgtgtatttgcttggctgtaggcctcttaagagcagagatacttttctaaaattgcctttgtgtttcttatactccacacagtgcagcataatggaagacgcatcatacatgtgactgcataaacatgggggattccaagtagaagaaataggatgaaaataagtatagagataataaaggtccttgaatgttcacagagattaatcatttcgtgtggttgtaatacacagttagtgaaaggaaagagtagatgatgaggctggaaaaatagacacagaccttaatttacaaagtctgaaatgctggagtcaagaggctgccctctataccctcaagtaggcactgagtagaggagctatgaatgacttgtatgcttgaaagcagttctccacaaacgtcattctggagtggcaaacaaaatagaatgaagggtggaatctcttagaactcactgcatgtctgctagattaaagttgtataatatttcactaggatacagtaggtagaaa

SEQ ID NO: 391041 - DNA, 603 bp, Homo sapiens
tataaaatgtatttcctactgtaggtttcaataaaaaagtttatggtgtgatacaaaataaattttgtgctgtgtatcttaatcataaattttgtgctgtgcatcttaatcggctctggattatgtacccagaatgggttagctgcatcacgggttacatagtattttgaatcttcctagacatagcaaaattactttccaaaatggccgtactgatttcactccccataccctaatcggtatttgacattctagtcagacttctacatttcctatgttcttgagggtgaaaattccattttgtttaaattttcattttaactggttaggttgagcctaacttcctcattactgaaaagaaaagtgttaagacctatctggttggtaggttactattgaaaatcatatttcttttcctttttttcttttttcttttttttttttttgagacgggtctcactcgattgcccaggctggagtacagtggcgtgatctcggctcactgcaacctctgcctcccaagttcaagtgattctcctgcctcagcctcccaagtagctgggattgcaggcacgcacctccaggtccggccgattttgtatt

SEQ ID NO: 391042 - DNA, 102 bp, Homo sapiens
cccacatggaaggcttctctgtgctcccagcgtcaggcaataagcaccttcatgtaggacctcccataacgctcaagacaacctcgagagacgaggaatctg

SEQ ID NO: 391043 - DNA, 653 bp, Homo sapiens
gttccgtttgaagacatcaactcattcctgagaaaaaccctatgaatgtccagaatgtgggaatgttgtcatttctctcatatctgctcaaggacatgtgaaaatgcacactgcagctggaccttgtaaatacaaaaatgtacacaggattacaactaatatttagaaactgcaagaatattttcagttttaacatttatttgaaaagtcgtgaaaactcccactggaaagaagttctataagtgaagtttttctaatttggaaagcctgatgcaaattaattatcgtgcggtgcttgaaaaaaatgtacatgtatgaaatgttacacaagttgcaagtatattgttttcatcagtggctcattcttaaagagtcttgagtatgcatttcactttattttgcaggaaaaccttgaggtgagagttctgtaaatgctttttaagcagtacttgaatttcatagtaatgatactttcttcagtttgttggtagaatttttgtctgttcatttgataatgtgctggattcatggttgaattttgatgtttttctaatatgtaggtaagtttaatttttttattttattattatttttttgagatggagtctcactctgttgcccaggctggagtgcagtggtgcggtcttggctca

SEQ ID NO: 391044 - DNA, 476 bp, Homo sapiens
gtgagtaggggatgaggtgggggctcagaggagggcatggtcagcctgtctgggagggagttgcatgtgtgcatctgaggtagggacaggcatgcatcttacaggatgaatatcgagcagagttacagagagggggaaactccttgaggtttcaggaatcacctaatccactgtgactcacaaattcctgcctcttggctttgcctgcagcatatctcctggaagtgtgctggggcaaaactcatcccagaccaccatctccatcctcccccaatacaccctggctctccctggctacccttgagcacggtgcacgtgtgcatgggtgcatgcctgcatatatagctatcccccatgtatttcccaaagccctacataatgcttcagtttgctaaggaaaaaatgttaattactgcaaatgtgtttaaaactgtaaaagtacattaaacaaactctgtaaagtgtgaaaaattagt

SEQ ID NO: 391045 - DNA, 566 bp, Homo sapiens
ggcaggccggcagcaggcggaagctgcacctcagggctgggggcgcgttggggagggctggccctgccaggaagtgtgctgacagggcaggagggctgagcggcagacacaaggcactcctggtccccaccagctgtggcctctgccaccccatgggtgccagtcttaagtttcagagcatcactggtactcaccctggtcctgcagctcctgggcccagagacaggatttcgtgttagcctcctcgtactgtgctggggtgatgataaaactaacaacccaggctggacgcagtggctcacacccgaaatcccaacattttgggaggccgaggtgggtggatcaactgaggtcaggagttcgagaccagcctggccaacatggcgaaaccctgtctctactaaaaatacaaaaattagccaggcatggtggtgcatgcctgtagccccagctactcaggaagctgaggcagaaaaatcgcttgaacttcgggaggcagaggttgcagtgagctgagatcgcaccactgcactccagcctgggcgacagagcgagactttgtctca

SEQ ID NO: 391046 - DNA, 686 bp, Homo sapiens
catggtggtgcatacctgtggtctcatctacaacaaagattgaggcaggaggatcacttgaggtgggaagtcagggctgcagtgagatatgatcatgccactgtactccagccaggacaacagagtaggacactgtctcaaaaacaaaaaagtcaaacgtttcaaaattattcttggaaagaaaagtgaaccaaacaaataaaaaggagccagtatggaccattacactctccctctcctttcctaaaggagagggctcatttgactagaataaaacctttcatgcctttacaaaacattatatacaaaatgttttgtatataaatagatttactgcctcattggattcaatatggcatgttatcatttttaagtagctaaaatgtcctactccaataaaaatgtcacattacatcatacaaatctataggttaaaatggaaagcctcacgtctttattgtcattttgctaaatgtcttaagtacttccttttttgtattttgagtaagtgaatactaaatcatgatagtagattaaaagttactaaaagtgtagtcttttatatttttaatagaaatgtattgccatctttcccttgcgttaaattgtatcatagaatcaacctaatatattgagatgaaaatatcattctttattattaatgtcctattataattgttcaatgc

SEQ ID NO: 391047 - DNA, 374 bp, Homo sapiens
cgtgagcacctcgtgggttgcatgtagtgactcggagtaccatgtgcagagcacacgtgtagcctcagcactgtatgaaagcacacaaaagaaaaccctgccctcgactaccttacacttgctagcagtctaatgacccataccacatgtggaaaatattattttgctttgctgtaatacaacattgttttgacaattcaggctaaatggttattatcaaatcatactatgtacaaggatcatgtcaggctcttcatgtggcccagacttaggatatatttttctccctcagataataagctccaaattttagctcttctcccttctctgtcctctctcctgccatctctgccctttcaccagccccagttata

SEQ ID NO: 391048 - DNA, 676 bp, Homo sapiens
tgaggtcgtaccctttgctgggagcaccgttttctcttttctttcactttctttcttttctttcctgccttccttcctctttctttctttctctttccttctttctttcttccttccttctttctctcttttctttcttcttttttcttctttctctctctctcatctctgccccccaaccccatctctctccttcattcctcccttttcttctcctttttgttttttttttggataacttacttttattcttgcaggccggagtgcagtggtgcagtctcagctcactgcaactttcgccttctgggttcaggcagttctcctgcctcagcctcctgagtagctggtattagaggcgcatgccaccatgcccacctaattttcgtatttttagtagagaccgggttttgctatgttggctgggctggtcttgacctgatctgcccgcctctgcctcccaaagtgctgggattacacttgtgagtcaccatgcccagcctattcttgcagtgttataagccaccatccacaattgatgaaaaatgtttaatcttggccaggcaaggtggctcacgcctgtaatcacagcactttgggaggccaaggcgggtggatcacaaaatcaggagttcaagagcagcctggccaacatggagaaaccctgtctctactaaaa

SEQ ID NO: 391049 - DNA, 169 bp, Homo sapiens
aaatatgtgctatatgattccatttctatgatgttctagaataggaaaaattaatctatggcagacaaaaaaatcagaacagtgactgcctctgggaggacagggcaggaagtgactcagaaggggcataatatactgtatcttaatacatgtttaaattacaaagatg

SEQ ID NO: 391050 - DNA, 342 bp, Homo sapiens
gagttaactgcaaagttggccagtagaagacaggttaagtatgatgcgatgctagaagtcattagaaagaatgaggtgggtctaagaactgtcgggatatattgtatacccccaactttcttaccactatgagccaaaaaaagtgcatgctttcaaaatttataaagattgtgcaaactgcccacagtggttatgtcttataaagaagtgaggttggagttaaagaaaaattgcagggcaggcgtggtggctcaagcctatagtcccagcactttgagaggatgaggtgggaggattacttgaggctaggagttcgagactagcctgggcaacgtagtgaga

SEQ ID NO: 391051 - DNA, 279 bp, Homo sapiens
atcgggagaagcgaaggcgcgtagggctgcctgcaatctgttccatactgctctcctgctatgccagggaaggtgtttatttttgcaagtgcctgaggttgggaagatcaggccccaagagagccagagcctctggccaacagtcagcgtcacctgaccccaagacaggagcacctgccaaaagccagggcagcctgacccccgcttcctgacccgccacatgtctccctcccggcacgcggccaccaccacctgcaaggccagtgcctcggaggcagc

SEQ ID NO: 391052 - DNA, 184 bp, Homo sapiens
ttaacctttctgtagcaggaagtagagaggaagtcatccaggcagcctcctatgtagtccagggtttgagctgtgctatactttagtctgtgtagtgtaggcactgtgtaaacactgggtggatggatatgattgccctataaatctttttcatttgttttgttggttctgggagccaaagaat

SEQ ID NO: 391053 - DNA, 435 bp, Homo sapiens
ttaaggagttgctaatttcaaatcaccattggcatctttctttgagcataatgtgatcctgctggaattcatggcacacctaaaccttatgttggtctcaagagaaatactactaccagcaattgatcttagatgtttggaccatcagtaaaaatttccactcatgaaaacattttaatgtttcctccaaatattttttgttactagagtcagaacataacatgaggtctaaactcctgacaactttttatgggaaaattacagtattacaaattgagcatcccaaatccagaaatccacaatctgaaatgctccaaaactcaacacttctgaccactgatgtgatgctaaaaagaagtgctcactggcgcattgtgcattttaaatttttcagatttgggatgctaaaccagtacatgtactgcaaatattcca

SEQ ID NO: 391054 - DNA, 411 bp, Homo sapiens
cctaattcctagcatgataaatagtaaccctttgtgcttgattttgtttaacttatttgagttgttttcaaaatacattctttttaatttaaaaaatcagctaagcttgtgtatggttaagtttttgttttgttttgtgtttgatttgttcttttagggaaaaaatcctataaaatggctattaaatttttagccaatgacaatgagattttcttaatattactttgaattctttacctcttaattcttagagtatgtggttttgttgttctgtagtgtcttactaaaatattcatttttttacagtgtattgcaagttccactgcattacatgcaaatatgattcactcatacctagctgtttgtggattcaaactcataaatgaaccatttttaagttgttaatagtgt

SEQ ID NO: 391055 - DNA, 192 bp, Homo sapiens
tttcaaggtctgtgaatagttagagccacattacaaagtcagtacaagatgtaacttactcatgcaaccaaaggtcaaaccaggactattaagggtatcactggagttacagtgacttgacacagttgtggcaaatggaaaaccaagagtttgcaatctggtttggaggtccttggtaaaatttccaagtgt

SEQ ID NO: 391056 - DNA, 597 bp, Homo sapiens
tccagttaaggtttagaaaatattgaatcatttgaaaccctttctatggagaacaaggtgctagggataaatgtcagaggagtgttaaaataagactgtgttaagacttttgaagaagaaaccagagatctctctatgacaatgacaaccagatactaacttctgacgaaacagtcgccacctccagctaagctccttcctgaccactagctgagttccttgtatttcagtttctactggcaccttctttttctaaaagggagcagtcacctaaatcctgaattaaaacatttgttctgaaacacacacacacacacacacacacacacacacacacagcgatacttgtaaagcattactcttcattgcagagatatcatggggtagtcagcaagtgtaatgtggccatcataaattcagatcaagtgagggcccttgtcttgggtttttggatatatactaaaaaatctttttaccagggctctgaaagagacccagaaagaaaaatagaaagcttaacttggggctgcaaatgtcctcacacagtagcagttaatgcttctgcaaatgcctatggctataaccccactgactctt

SEQ ID NO: 391057 - DNA, 510 bp, Homo sapiens
ctagagcctgcaggaaaagattcagctttgagataatcccaggcgcagggtggctaaagcaattctggaaactgggctgtggaagaaccatttttaagctgtttgccaccacctctgctatgctttactactaattccactcagttttacctttactccatgtagttttccagtgggtagacagagggcaccgtggcgctgggctttcagtaatactttctaagacacacactggccagtcgcaagatggccctctcctcagcagcttcgagcttgaagcttgaagcaagtggggaatgaatacaaattggctttaagcatcacctcggctactgagtccccaaggatcacctgcacaagtgctctgtcagcagaggcgcccgaggtacaggcaggatgggccttgtgggcctctcctggccagaaggagatcatgccccttcccaggctgagtgagctgcactgctgatcttacctcctcttgttctttcttgatgtggctgggccttg

SEQ ID NO: 391058 - DNA, 385 bp, Homo sapiens
ttggctgatggattggatgccaggtaagaaaaagagaagttactcttgactcaggtttttgagctgttacaggaagactatgtttactgttaccgaggtgggtaagactgaggacagagcatatttgcaagagtagcatcagaaacatggtttttgacaaattgaatttgagctacctacttgatatttttatccagtgtcaagcaggcagttttatatatgggtacaaagggagaattgagggctggagatacaaatttgagagtcatcaccagatagtagatggtatttaaagccgtaagtctggatgaggtaactaagagagtaaagtatgtggaaaatagaggacccaagaaaacttagggcagttcaacagttacaagtc

SEQ ID NO: 391059 - DNA, 707 bp, Homo sapiens
gggtagccacaggaggtgttcattaaggatatgattccatttatatagctatttctattgcataaccaggacagttttattgtttttgaggtcaatgttcttttaaaatttgattttctgtaagaagaggctttttggcccagaaagccttacttattttacatcttccagtttgtccatcccatgagttagagttcgtcttgactctgcaagctagaatcaaagaattatgaaagtaagatcatttagatttgaccaagggcaccattaaatggtgtcaggttttaggaagcagacgggtgtataaaaagaaaatgaacaaagatttcacttattggggatcaggcataactggatgcctggattgtcctgccacccagctgccaccaataaaatcattcatcactctgcaagagggaccagatgcttccatcatcagtactccttgtttttctgttatctcctttgaggtagctaaaaatggcagccaaaaaaaaatgttgaggcttttctcaagtatatactcatgttattttgcagaagatagggtcaacttcttcagttgagttatctgaaagtgttgggcagtgacaccatgccaaacactgttaaattcatgccattaaaaacagtggagtgttctgcaaagcccgattctctgcagctttaagactggacagtattgaaatattcacaggaatcttcca

SEQ ID NO: 391060 - DNA, 158 bp, Homo sapiens
aaaagatcctgtctgggacaggaagctgcacacggagcagacgcatccttggctttctttctaaatcgggttactcatttttccatcccgtccactgagtatgcaaaggatttgttgaaatttggccggtacatttccatcctccctgatgccaatca

SEQ ID NO: 391061 - DNA, 603 bp, Homo sapiens
aagaaaacggaaactagagtgctgcccaaattactctcatcccagggtgactgaaggcatacccaaaactgcctccctgaggagcaacatcagaggcttaacactggggggcgatagtcttcattaaaataatccagcttggcactaaacaaatagcaaataagcagatagcagtaacaaccctgggggagcagggaattgttaatagtactcagagttgctacagtatattatctgaaatgtgagtttttataacaaaatattatgaaatatgcaaagaaacaggaatatatgactctactggacaaaagcaggtaacagaaactgccttgtgattgcaaccagatatcagatataccagaaaaagactttagaatagccattgtaaatatattcaaagaactaaaataaaccatgattaaagattataatgtttccacttttattattcattggaatgcaattaaactatcagaaggcatttagctaaatcaagaattcagtaattttgcaggccaaataatacatcctttatgcatgtgatgtacttcatcttcatttttcatcatggataagaaggataataatcttggttgcattcct

SEQ ID NO: 391062 - DNA, 426 bp, Homo sapiens
agccagtctaggccacagcactgctagtaagtaaacatggagccacagagacttcaagaaaggcaaaacatattttaaaaccatgaatgctacttcttccatgctcctaaatgctaatttttgatatatcacaataaaaatacaaaggtagttattatatagataccgaggagaactagttaatcaaggggtagctcaagaggatctacataggaactttagcagatattcctgaaatgtttagacagttttaaacataaagttagaaagctataattcagagcactaatcagtgcctggcattaatgaatgcccaaatatttgttaaatggttaaaaataaacctgtatgagataaagtcactaatctttacctttagtcactttactcacatagtgctgtatgtatattattttttatagaaac

SEQ ID NO: 391063 - DNA, 779 bp, Homo sapiens
tgggctgggaaccatccaaatggaatttttagtgtttcgcctaggtactttagatttagtacacactaaatgagtttgagtgtgttttactactgcagtggctagaaagaacaaatagagtattatgtggaatacaaataatgcttattaagcttgcagttgattccttctgatagatgttccaaattgctgtcagactatatttacttactcataaacagatgtggttttgctttaaatcaggataactattccaaactgagttatgcatattttaaacaactgttacggattacattttaaaattattgttgattaagaagctgatttattatattttataaggttcatttttggtggtagttttagatgacagagagcttagatttttttttaattttttgaaatctgatttaaggtgggatatcaccagttaaaaattattttctggtctgtagtcaagaattgatatttaagatgagcaatttgttataattttaaaattttagtcactaggctgggcgcagtggctcacgcctataatcccagcactttgggaggccaaggcgagcggatcacctgaagtcgggagttcaagaccagcctgaccaacatggagaaaccccgtctctaccaaaaatacaaaattagccgggcgtggtggtgcatgcctgtaatcccagctacccgggaggctgaggcaggagaattgcttgaacccaggaggcagaaattacagtgagccgagattgcgccattgcacttcagcttgggcaata

SEQ ID NO: 391064 - DNA, 640 bp, Homo sapiens
ccatcatccatttaggccagagatctggaagtcaccattttcctcatcccccatgtccaatccactagcaggtttggttgataccctacaaatatgacctgcttctgaggtgggatgggagactggactctggaggcagggcttgggcatcggaccaaattaaggacaagtaaaacagggaaagggcggaagcacctctgcataagacacacctaccagtgtgcagtgacagtttaccattgctatggcaacatccggaagttagcgcccctttccatggcaataacctgacaatctggaatttaccactttttttctagaaatttctgcataatctgccccttaatttacatataattaaaagtgggtataaatgtaacagctgctattctgggctcactgcgtatggagtagccctgcgctgcaaggaacaggacctccgctgctggctgtgcactgccgcctcaataaaagttgctaacaccagccgggtgcagtggctcatgcctgtaatcccagcactttgggaggccgaggtgggcagatcacttgaggtcaggagttcaagaccagcctggccaacatggtgaaaccccgtctctactaaaaaattagcagggcatggtggtgcacacctgta

SEQ ID NO: 391065 - DNA, 249 bp, Homo sapiens
atcaccttaaatgtttactgtttctttgtgatgagaacattcaaaatcttctcttatagctgttttgaaatatgcaaaatgttattattaactatggtcacccgcctgtgcagtgatcagagatttctaattcctgtgtgtgccctggattcttgagactcctcccaccttgggtttggtgtatccgtgtctgtgtacactctcttgcccaagagccctgtgcccacctgttgccccagtccatcctgg

SEQ ID NO: 391066 - DNA, 353 bp, Homo sapiens
caagttccacccattaaacctttcagttccacagatacccataaattccctctatatatacggtgtaaaacatacacaatgttgaatgtactcaaaattcatttttgctttactaaacaaaaagtgaaagttttattaagtcaaatgaaacaaaaataattttatgttgttgtttttatttttttatttttttctttgagacggagtctcactctttcgcccaggctggagtgcaatggcgtgatctcagctcactgcaagctctgcctcccgggtccatgccattctcctgcctcagcctccctagtatctgggactacaggtgcctgccaccacgcccggataattttttg

SEQ ID NO: 391067 - DNA, 1016 bp, Homo sapiens
gcctaggattggttaggtgggcttttccttcccctttccctccaaagaaacccaggttctggttctgcacctacccctgcccaacagtggccattggcccatcacccgctccaatgtccttgacccgaattcttggaagcacaggaaacaacatgccacataggggttgagtaagcatctctggggccacaaattaaattaagctttcagggccgcctgccttgttattgctaatggttctagccctgctcagctcctaggtccctgtcctgtggaaatttgtggaccctgggcaccctctcttgctcccaaattttaatcggctcctggaaacctcaccccaaattggagataggcactcctcttgtagaacaaaaggctcaggttcagggagtgagggcctgaactgtgcccccaccctccaggaagggtccttcacggcctggctgcagggatcagtcacgtgtggcccttcattaggccctgccatataagccaagggcacggggtggccgggaactctctaggcaagaatcccggaggcagaggccatgctgaccgcagcggtgctgagctgtgccctgctgctggcactgcctgccacgcgaggagcccagatgggcttggcccccatggagggcatcagaaggcctgaccaggccctgctcccagagctcccaggcctgggcctgcgggccccactgaagaagacaactgcagaacaggcagaagaggatctgttgcaggaggctcaggccttggcagaggtactagacctgcaggaccgcgagccccgctcctcacgtcgctgcgtaaggctgcatgagtcctgcctgggacagcaggtgccttgctgtgacccatgtgccacgtgctactgccgcttcttcaatgccttctgctactgccgcaagctgggtactgccatgaatccctgcagccgcacctagctggccaacgtcagggtcggggctagggtaggggcaaggaaactcgaataaaggatgggaccaacc

SEQ ID NO: 391068 - DNA, 493 bp, Homo sapiens
agagctcattttctgaagagattaggttgatctagctctctgaaggggccatgttatcttgagctcatggtggttgcatatgaagtttcttcttcctggaatctctttgctgactttgcaaactggctgccatcccgcccatttcaactcacagagcatttcctttaggaagctttccctgaccacctccttttcctcttgcctgagttacatgtcctttcttagatcctgtgggtcctctgtcatcgagtctttacacatctttgccacaagaatacgagcagagttagagctggattttgtctgggtgatggaaaattaatgctcaataaatatttgttgagtgaatcaatggacaggcaaacctatttgggaacagtattcactttgagtttattaatctatatatgataaagaataaaagtatattttttctactcttttttattggagacattttgatggcttgaagcagttctggaatggtaaaaca

SEQ ID NO: 391069 - DNA, 129 bp, Homo sapiens
cgctctcatcctctcttgccttcccttaccctctctccctcttcctttctctccctacctctctccctctcttctccctcctccttcctcccttcctttctccctttctccttctctccttttctttct

SEQ ID NO: 391070 - DNA, 381 bp, Homo sapiens
ggaaagagccctggactatcataagactgagtaccagcttggccagtcagtcactttgtgaccttgattaagctatgtaaccttttcaaattgatttccctctctgtaaatagagctgataagatggcttgccctgtttcctgtggtttttaaagaggatcaaatgagtgcgtgaaagttctcatgaaaactagacgtctattcaaatatgaggtggtggtattctcagaaggtcatagatgaatgatgcatttattttagtgcttttcacagtttagtctcaatactgagtgcttactgaggggttgtatggaggcacactagttgtttctttaggagatgtctttagctgctagagtagagaacaaaagaatgagtaaa

SEQ ID NO: 391071 - DNA, 376 bp, Homo sapiens
tttaagacctacctgcattcggatggcgctgggagtgggggcctccttagatgtgggctcctggatgcttctctgtcttcacctggccccagcctcatgggtgcagctggaaagactctagaaggatgtgctgaaaccctggggctccctgagactgagtgagctggaggtcaccaaggccctcggcctatcgcgggagagagttccattgaaagccagtggtcaggtggccgctgtggagggtctctgggtggacaattgggagcagagtggtccctgcagtgaggcagggggcagggcgtgaggggtccctgaagtaaggcagggcagggcgtccactcataagcacacgaggagttgcagaagcagagccgac

SEQ ID NO: 391072 - DNA, 272 bp, Homo sapiens
ggatcacatgcgtgagccaccgcacccagaccacctgcacatttagaattgtgaactttttctctatacttcaataacttagttctaagatttatttgacacaaagttctcggaaatcgtagttatcattttagaacagaaaaaagaccacctgggccaggtgcgctggctcacgcctgtaatcccagcactttcgaaggccgaggcgggcagatcatttgaggtcaggagttcgagaccagcctgaccaacacggtgaaaccccgtttcta

SEQ ID NO: 391073 - DNA, 358 bp, Homo sapiens
ttagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacg

SEQ ID NO: 391074 - DNA, 312 bp, Homo sapiens
atgcttcaaaggaaaaagagatgctaacataattatttaagaggtacttaatttagattgagagtttcagtggaagacctgagagggtgacagtgaagatggtacttgaagtatggataaaaattggccagatgaagagtggtggtggagtacttaaaaaaagtacaatttggctaggtgtggtggctcacagctgtaatcctagtactgttggaagctgaggcaggaggatcgcttgagcctgggagttcaagaccagcctgggcaacatagtgagaccccatctctacaaaaaagaaaaaagaaaaaatt

SEQ ID NO: 391075 - DNA, 183 bp, Homo sapiens
tcaactcctgctcaagaccccccaggctcagccttactgtgccccatgacaaggactgtccatcctcttttccacggctgaacctcatctctgtgtctcacaacctcgaagacacagaatcatccctcctgcagcctcacaccccatgtagagacgcctcctgcaccctcgtcccactgcttc

SEQ ID NO: 391076 - DNA, 440 bp, Homo sapiens
tagactaaaagaacaaatcaagtcatgttaatacgccacattagttataggttgtaaggaagtaagatttttaaaataagtctagaccaggcatggtgactcatgcctgtaatcccagcactttgggagggtaaggtgggaggattacttgaggccaggaattcaagaccaacctgggcagcatagtgagaccccatttccatcaaagaaaaggaaaagtctgggtctaatgcttacaaattaaacaaaggagtgagtctcttgttgcagctaataatgtgatcaagatttttttcccctgggtaagactattgttatatctaataaaaatacattttaacattatattttatattttacagtcaatactttgttgttctgacaatcaagacacatattcctgattaaattagtaaatcatttatgttgatggtagacag

SEQ ID NO: 391077 - DNA, 155 bp, Homo sapiens
agataggttatgtttgtaatcccagcacttcgagaggcactgtgcctggcctgggacactcagatctttttaaaaattgtaagggaaggaggacttttgtggctattgttgccattttatagatagaaaccagtggttttgtgatcagccataga

SEQ ID NO: 391078 - DNA, 364 bp, Homo sapiens
tggagcatctgtaatctcctggtgacaccagagaccgtggccctggcattgttgaaattccatctgaaatgaatgacggaaaaatgggagcccactggagaacttgagtgagggcgaggcgggtggatcacctgaggtcagcagttcaagaccagcctggctaacatggtgaaaccccatttctactaaaaatacaaaaaaaaaaaaaattagccaggcatggtggcatttgcctgtaatcccagctactctggaggctgaggcaggagaatcacttgaacctgggaggcggagcttgcagtgagctgagatcgcgccactgcactgcagcctgggcgacagagcgagactccgtctcaaaaaa

SEQ ID NO: 391079 - DNA, 243 bp, Homo sapiens
aggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgca

SEQ ID NO: 391080 - DNA, 252 bp, Homo sapiens
cctaccactggctatgtgttctgcacatgttatctcatttaatagtctaattaaccctagcaggtataaccaaccccctctctgcaaataagtaaatggtggctggcaaggctttaggtaacttccccaaagtcataggtctatgatcggacctcatgctcttgtctgctaaaacttgcaaaggtacatatttatgcatcatagtaaaaattaaaatcttctacgtcagccagctacccacaatcatactta

SEQ ID NO: 391081 - DNA, 134 bp, Homo sapiens
aaaaaggaaaaaagaaagaaaggaaagggaaggggaggggagggaaggcgaggggagggaaggtaagattatatggggccgggcgtggtgactcacacctgtattcccagcactttgagaggcccacccgtgaa

SEQ ID NO: 391082 - DNA, 361 bp, Homo sapiens
cttctccgagacagtttcccaatctataaaactgagtaaatctctacttatttcactgagcttattaaacattagttccttccctttgaggcaacagtgtttctgaaactgaagaccaatataaaatttataacaaagtttataacataaaaccccctaaattttttgttcactgaaagatgaagctccagctactaagaaaggcctatcagtcttattactcaatagggaaacctggaaaccagagtgcttaagggaaaggaacattattgaaagtggaaaagaatctgttctgatattcatggagccctttaggctccatacactgttatctgttttttgtttgtttatttgttttttt

SEQ ID NO: 391083 - DNA, 547 bp, Homo sapiens
ccaaagtgctgggattataggcgtgagccaccacacccagccatttttaaaactctttttaaaacatgatttgaaagataatttcattttcaatcgtagggaattatacaatcatttgttagccattcttctatccccctcccattttttttttgagaagagtcttgctctgttgcccaggctggagtgcagtggtgcaatcttggttcaccgcaacctccgcctcttgggttcaagcaattctcctgcctcagcctcccgagtagctgggattataggcacgcaccaccacgcccagctaatttttgtatttttgtagagacagggtttcatcatgttggccaggcttgtcttgaactcctgacctcaggtgatccaccggcctcggcctcccaaaatcctgggattacaggcgtgagccactgtgcctggctatccccctcccttttttctttttttgagactgtgtctttctctgcccaggctggagtacagtggtgggatctctgctcacaatcgaattcccgcgggcgccatgggggccgga

SEQ ID NO: 391084 - DNA, 587 bp, Homo sapiens
ttcaagccggtctcctcccttagcctcccaagtagctgggactacaggcatgcaccagcacgcctggcctagtttttgtatttttattagagatggggtttcaccatgttggccagactggtcttgagctcctgaccttaagtgatctgccctccttggcctcccaaagtgctgggattacaggcatgagtcaccatgccgggccagttgagatttcttaatctctcagcgtcctctgatcatgatcctgtggggatagtagtatgtccctctgtatctcacaggattgttgggagattcaattgagataatatgcgaaaagaaccgtgaactacaaagcactatatcaatgtaaggtgttttctgttcctcttgtatcacatttgtccactgaagtaatctatgcttgcaggttagcactctggacttaacaactgtaaaacgtgaattaacttgggttatttcacttctcatttggaaatgaattctgctcaggacactgtagcattcttctatctacttctgaaatgcagatagcctcacagttgtaactaacactggaagaggagaaagaagaagtaaaacga

SEQ ID NO: 391085 - DNA, 325 bp, Homo sapiens
  misc_feature (324)..(325): n is a, c, g, or t
agacagggtcttgctccgttgcccaggttggagtgcagtggcccatcagggctcactgtaacctccgactcctgggttcaagtgaccctcccacctcagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaaaaaaaann

SEQ ID NO: 391086 - DNA, 2047 bp, Homo sapiens
  misc_feature (2046)..(2047): n is a, c, g, or t
atacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacatttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaaaaaaaann

SEQ ID NO: 391087 - DNA, 359 bp, Homo sapiens
gctgggattacaggcgtgagcccactgtgcccagcccaggattgtatcttttaagcagaaaacttaatagctttgttcatgacttaaaaaaaataccatgagaatcattttaccaagtaatttactttatacaaataattagaaattatgctatcactaaaacatagtttaaatatttttgaaaataacttagtgttgtcataaaatagaattggaaaaggcgggtaaatcaacataattggtaactggcaaaagtttcaagcattctgcctaagaactggagcaagacaaggatgcccgttcttaccactcctattcaatttagtactggaagtcttaaccagagcaatcaggcaaga

SEQ ID NO: 391088 - DNA, 121 bp, Homo sapiens
cactgaacaatattcagaaaccgtccacctcttgccccttctttgctcccacctagtcatctcagtggcctccctgtgcctaccctcatgccctgcagtctgttcccctcacatagtcaga

SEQ ID NO: 391089 - DNA, 369 bp, Homo sapiens
gtcactgggattctggttcaagtcatggtagcaatgctaattgatgatagtcatctatattttcttaaatgttttcattaattgacatccttgtccaagtaacatctatattgaaccttaagggagatgtcatagttagtttttcccaccttttttatagtaaattttatgtttttacaatctgcacaggtgtctatgtacttcttgatcaaacagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactggg

SEQ ID NO: 391090 - DNA, 342 bp, Homo sapiens
tttggagggggagttaacagctttactgagataaaatttacatactgtacaattcacacatttaaagcatacaattcaatgatgtattcacagagttgttgcaactaccacagtcaatttaagagtattttcatcacttcaaaaagaaaccttgagcccattagaatttcccattatctgttttcctccagccccttcctagccacaggcaactgctaatctactgtcactataaatttgtctattctaaacatttcatataaatggattcatgcaatgtaagaccttttgtatctggcttttttcacttaatataatgtttttaaagttcattcatgtatc

SEQ ID NO: 391091 - DNA, 288 bp, Homo sapiens
caacaaacaaaaaaaagtaagaattagaaaggaaacacaaagtcattgattagtcagaattatgcctcaagtacacacataaatctgtgcatttacatgtttactcttagctgttcatacttgatttgcatatagttatagcagatcaagaagtcacaaacttgaaagagaaagagttgctgctgtggatggatccataaacaatggtctaaaattggcctaggccgggcgcagtggctcatgcctgtaatcccagcactttgggaggccaagttgggaagattgctt

SEQ ID NO: 391092 - DNA, 396 bp, Homo sapiens
tatacagatatgactcgatgaaatattcaggtcatagtttcttttccagtcacccagactggagtgcagtggcatgatcttggctgactgtaacttccacctcctgggttcaagcgtttctcctgcctcagcctcccaagtagctgggattacaggcatgcgccaccacgctcggctaatttttgtatttttcatagagatggggtttcaccatgctggccaggctggtcttgaacttctgacctcaagtgatccacctgcctcggcctcccaaagtgctgggattacaggcttacaggccttgtgagccactgctcccggccccaacttttgactgcattgtaggatctcacagagaactttctagaagtgccaacaacttgtgttcatcctcct

SEQ ID NO: 391093 - DNA, 340 bp, Homo sapiens
aaagaaaatgtcatcagactaatgcatgctacaacaggatgactttgaaaacattatactaagttaaagccacacacaaagagccataaattgtttcttccattcatatgaaatgccaagaataggcaaattaccagacacagaaagatcatggttgccaagggctgggaggagaggagaatgggggagcgggaggcggtgactgctaatgaacatgagctttcttttggggatgatgaaatgttctaaaatggactacggtgttagctgcaaaactttgtgaatacactaaaaaccactgaaatgcatatttattcaaatacacaaactccacagcatg

SEQ ID NO: 391094 - DNA, 308 bp, Homo sapiens
acagacacatatatgtatatgtagacatacctgcaaatacaaaatatttccagaaacttctatatttatgtgctatttcttcttactgtcaccttcaatgtaaatggacatttaaacatttagggagcaattaagtcttcaagatgagttgcttgatgaagtaacatttgggcacttgtttaagtacattttacagggcccatccagttctaattgccaggaacaccacaggtaggacaggtttagcagaaagaaaacatagtttggagcaggaagaagagtgccccagagagaaacagaaggctgtt

SEQ ID NO: 391095 - DNA, 157 bp, Homo sapiens
tcttcctgatgacaaccagcatgggcatctacctcagggttgttggcagatcccagcagagaagcaggtggatgtgagtttgtaaacttcccaatgctactgctgtaataactgtttggtaagcacctactccatgcgtggattgccagaagacact

SEQ ID NO: 391096 - DNA, 789 bp, Homo sapiens
gcctagtaggaagtgtctgggctgtggaggaacatccctcatgaatagcttggtgatgttctctggcttggtagtgagtttctgccctctctctcttgatgggattggttcttgtgggaatagattagttccagtgagagtcagttgttataaagccaggagcccctcagatcctcccctcattgcatatgcctgcttcccttttgatcatctccaccatgttttgacacagcataagagccattgccagaagccagggccatgcccttgaacttcccaacctgtgaaaccataagctaaataaacctctactctttataaactacctagtctcagatattcttttatagcaacagaaaacagactcagactcttcccttggtatttgctgcactaggaaaacaaaagcaatcaggggtcatatcttttcatcaccaaacccatcaaacttcttacatctcctccttaatggactcaccctttcccgccattgtaatgccctgctgtgtcccaagtggctagctcagggcctggcacacagtaggcactcagtatttttccagtgggatgaataaggccaacctctcaaggacttcatatttgcaattcatccctctctcttagccctaatcaattttctgtcttgattgcatcataaccatcattatacaaacatgctatattttctttcatcttgaagaaaccctactttgacctttcatccccctcaaatttctaccacattgttcagttcaactttataattaaacatgtccaaagaactgtcta

SEQ ID NO: 391097 - DNA, 540 bp, Homo sapiens
gattctctcagaggaaagcggtggtttacaaagcttacacaaccagaccctcggttagttctgacctcagctcctactaccctcccctccctcattctatttcaaacaatccggcaacctaagccctctaaatgatgaggaactaccaggagcaaaattctgagtttagggtcacacaatgctcttctgaatgaaactaaccaactggacgacttcaaataaagctatgttctcctgttgattagaaagctcctcatttcctcatttggataaccacatttggaaagaagaaaatcctgagatctcaggtttcaggcttccttttagccctcacccacagaagtggtccccatgggtcagggatctgccctcatagatgttcactggccactatgagaatcaccaagcactgaggacaggagagctctcctgctgatccagcactaccacagccagctctgaagactgaaaggtaaaggctgtttaaccaattaagactgccaaagcagggcacggtggctcatgcttgcaatcccagca

SEQ ID NO: 391098 - DNA, 379 bp, Homo sapiens
gaaaagagaaatggtgtttggctgagtcttaagctggcctgacaggtgaggaagctggaagacagtgttctgagaaaaggcatacaagtgtaagaccgtggtatggtctggaaatctcaaatactgctaatgttcacggtactaatggggcagcctcagaagctggctaaaaaggtgaaggctgaatcacaaaggatctcctatgctatgataaggaactcatatgtgatgcttagaagccataagtcatcactgagggtgtttgaacagggcttatgtgaactgatttccatattagaaaggctactcgtataactttaggaatgaattagggagtcagggtagagatgtggggactttaggggataaggccctgaac

SEQ ID NO: 391099 - DNA, 257 bp, Homo sapiens
cagcttcctgagtagctgagtaggtgggcatgcgccaccctgcccagctaatttttgtatttttagtacagacagggtttcaccgtgttggccagatagtctcaatctcttgacctcgtgatccacccacctcagcctcccaaagtgctgggattacaggcatgagccaccatgcccggccggttaaatttattcctaagtgttatgcctgtaactcttgaaaaagtaattcttaaataaacatcaattaatattct

SEQ ID NO: 391100 - DNA, 226 bp, Homo sapiens
gttttttttagtagagacagggtttcaccatgttgcccaggctggtctcgaactcctgagctcagtcaatccacctgccttggcctcccaaagtgacagaattacaggcgtgagccaccatacccggtcgacagtgtactttttaactgtcacctttcattctttaaagtacactggtctggatcataaaccaggtggccgacatactcctagcctactgaaaggt

SEQ ID NO: 391101 - DNA, 271 bp, Homo sapiens
acagggtgacaggttcgttctctatgcccagggagcatagtcttattttaggaggctatacggttatatttgaggaaatcacacttaattttcccaaatgtgttttaggtgcaacctatccagtcactttccttttgagagctgaagtacctgaagctttggagatggtaaaggaattattgagggtcatactggctaagaagagtgctaaaagtggagacctttatcacaaaggtatcttgtttatttgcttatctatcaagccccaata

SEQ ID NO: 391102 - DNA, 457 bp, Homo sapiens
ggcggtgtgaacactgggttcgagttccttaaggagtcgtgaactggcctctacttctctatcctagtgtaaacttatctgaccaccaaggtatatagcttgatgaccaacaaataatgtacccattgccccagagtacctttcttctgagcatacgactccagcattcattggatcggctagctagcatctcagtccacactctgagctgtgcagcagtgtgccctggtgctaattctcactctgtcctttgattctggccagggggtccttggtggtgctgccttctggtcaggaatgtgggtgaatgtcagaccaaatagtgtcactttcggcttggccctagagatcaggaaggaagtgttgttagagcaagggctttgggagtccttggagttcgtaacctttgaatctgaaaagtaactgtacctagtaaattagaataatttctctctgg

SEQ ID NO: 391103 - DNA, 336 bp, Homo sapiens
attgactgatgggctttgtgtagctgttctcctgaaacaggcagagacagcctaaacgtccctcagtgatttccagtgacttctcagcatggaccatgggagtgtcaaatgcttcctttattttaatttattttattattttttgagacagggtcttcctctgtcacccaggctggagtgcagtggcaccatctcagctcactgcagactcgactctaatgttcccttggatataacttagtaaaggccacctgtcctgttgtgtgggctctcctggggtcctgtctcaggcccactgtcctccaccctctgctggaggtcgttgttacacattct

SEQ ID NO: 391104 - DNA, 655 bp, Homo sapiens
catcacatttttaactgtcccagtattgatcaccctatagaggaatgagactgaagtctggtagttattagtataaagagggtcagctgcagagactggtaccgagtagaggctctcatggtaatgatgctgctatttatagatccccatttcattagttgcagagtttcaaggaagagattttctctaggggaaatggatacttgaagttcattttcttcctcatattaaggcaaaaatgtgaacaaccttcagtataggacatatgattacagtatttttgcaggggcagtttatattctaaatatatttgcaatagtgaatgttgtaaatttaaaacaatgtagagattcagaaatgttagttgctattctggctgagtgctactttacgtacattgttttattacccttcttgtcattttttttcttgtaaaaattactaaattttcaggaactgcaaagctgagtacaatcatgactgtattccctttctttagagtgctgtaaggcctttaagagagttaactgattgcaagaagtgtagttccccaaaaaatatagtccacccactatgtgtatctgtatatatttgtaatataggtaattgtgctttccttctcaaattctttacctttgagttatttttttccctt

SEQ ID NO: 391105 - DNA, 307 bp, Homo sapiens
ggcatcctcacatagcagagaaatggaaggtgaaaagggcctaagctagttccctccagcacttgtatgaggcgctggttcagagtccccatggcttaatcacttcccccaaaggccccacctcttaatatcactactgtggggattaagtgtcaacatgaaattttgagaggacgcattcaaaccatagcaattgttcttggtcattctcttgactggagcctgatagtcaagagagacattttagcgtgtgtccttataattattattggtgttgaaatctaaaagtggctaggctcgctgggcg

SEQ ID NO: 391106 - DNA, 429 bp, Homo sapiens
gcgctcgtagaggatcccgtcgcgaaggtgttttcctatctctatgtttccagatggatccatttctacatgcatttactatcaacattaaatctctgccaatgatgcgtttaaatcccaacaaacctgaaaaaccaaatacttcaagcccaatgccaaagaagagcctatgagcatgccagctgtttgccttttcaccttcacctaacaccactccctcctaatggaaaatttcaacatgcaaattgttatgcagatgcagaacacagataactggtaatggctggtacaatattccatgaggtttctaacttacaaaaccacattgtattcatattctgtatttgtgtcacagggaactgaaccccagaatgatcttaatcctcaaatgccattaatgaaaccattttcattaagtagcgaagtcca

SEQ ID NO: 391107 - DNA, 120 bp, Homo sapiens
gattaatacagaaaggtaacataagtcagttagatcaaaactgccaaggccccaggaagtaagcctcgccccagccaagggggatgacgagaagcttccaattcaccagcactatcggag

SEQ ID NO: 391108 - DNA, 479 bp, Homo sapiens
caattccaaatacactggcttacgatcttatttaatatattatattctttaaagacaaaatgctgtgaattagcccatattttagttttgaatatggaatggtgtgttgaaatgacatgttgtagtagactcacttaaaagcaacaaaactcaactagccaaagcaagccaaaactggggaaaaaaaaaaatccctagctcaaattagtctccatttgtttactaaaaaaagaacaatcaatacaatcaatgaagacttaattttacaagactaaatatactacaaccaacacaggaccaaaaactaagccaccttaaatataacccattatgtatttcttcataattatgaaggccaacaagtttttatctaacaaaacaatctcattttaagaaaaataggcagggtgtggtggctcacacctgtaaccccatcagtttgggaggctgaggtgggcggatcacctgaggtcaggagt

SEQ ID NO: 391109 - DNA, 1145 bp, Homo sapiens
tctcatacagactcaacaaaaggcgaagaaagtacggcaatttaggaggtgtgggctgcaccactgcttttcaaaaggaactccattgttgaaatcccatagaggttgtcattttctcctaagaggacttgcttctaaagatccttgtggctacataattccttaaacagatgaaaatgggagactggcttttctggttgtgtttcttttagggtagaaggaaaacaactgaatatgatgtgagactttatggacaagaaagtgaaaataagctgtgctcagcctcacacagcctgacgcgcttgtgggaggtgcctgtggtgcctgagctgtgtcatcaaggccccggacccctgagagcttgcacctccctatttaaacaatcaatgagcctgtccccgaaggtttcaggtcagctacagctgctcctactggatggaatgggaaatagaaggctttggtggtaaggggcggtgtgggctggcgcatgctgagaatgtgccaagcggcctttccacaccccaaatgcccacccccaacatccatcagccttcttgtgaagtccagcaggctgttcttgtgaagattctatggtggaacagtagttatgaacagtgacttaactaagatgtcaaatgctcttaataaattttagtaagttttttgaattgtgtgctatatgttgtttcatgtttcctcaagtttagtaacaactacctcttcctacaggacttcccttagactttaacaaaacgcaccatagaacagtgcccagcttggagaggtctgtggtcatcagggaaagagggactgaagaagacaaggggctgtggagtggatgcagggtgtaggtggggtagatgtactgctatagggagagaagaaaggtggtttcagctcagggcagttctggggaaggaaaaagaagacctgatctatgaatggcagagtgcaggcagcagcccaagacacactccactgacttcagatgtcaggttccttcccacaaactctgaactatcctgcctacctcgcctcctcctgatttgtatagagaagtggtcccaactgtcaggcatgtgtctggccactctctacacctcgccagccttctctcactggactctccatttccctttcatccc

SEQ ID NO: 391110 - DNA, 550 bp, Homo sapiens
tgagacagaatcttcgctctgtcacccaggctggagtgcagtggcgctatctctgctcactgcaagttccatctcctgggttcatgccattcttccgcctcagcctcccgagtaactgggactacaggcacgtgccaccacgcccggccgattttttgtatttttagtagaaacggggtttcaccatgttagccaggatggtgtcgatctcctgacctcatgatccacctgccttggcctcccaaagtgctgggattacaggcgttagccaccgcgcccggccgcatgttccttaaggttatccaaagcaaacatgaaggcagattcagaacaaatgcagaaatggctaacatatgatactgcgtctggaatttattccttccagtgggttcttggtctctctgacttcaagaatgaagccgcggaccctcgcagtgagtgttacagtttgtaaagatggtgtgtccagagtttgttccttcagatgttcagatgtgtctggagtttcttccttctggtgggttcatggtctcactgacttcaggagtga

SEQ ID NO: 391111 - DNA, 621 bp, Homo sapiens
tcaaagccaatatattttcctttatgcatatatgttctacctgcttaaattttgattttaaaaaataaaaaaagggaaccaggccaggtgtggtggctcaagtctataatcccagcactctggggggctgaaacaagcagatcacttgaggttaggagctcaagaccggcctggccaacatggtgaaaccccatctctactaaaaatacaaaaagttagccaaatgtggtgatgggcgcctgtaatcccagatacttaggactacaggtgtgcaccacacctggctaattttctaaaaaattatttttttcgtagagacaaggtcctgctacattgcccaggctgatctcaaacttttggcctcaagcaatcctctcaccacatcttccaaaggcactgggattacaggcatgagccaccatgcctggcctctcaaagttttaaggactattctttaaacttttcactgcttgattttgctttagtgggtttactttcaacacaacatttttacctgttgtagaattaccaatgccagagatgtatttgttagtgagatcaaactgctctcacacaatcataggcaaaatgtgggatgtatttgtatctctataggaaatg

SEQ ID NO: 391112 - DNA, 156 bp, Homo sapiens
taatgaggcggagtctcgctctgttgaccaggctggagtgcaatggcatgatcctggctcactgcaacctctgcttcctgggttcaagtgattcgcctgccttgctgggatgacagacgtgcaccacaatgtccggctaattttgtatttttagta

SEQ ID NO: 391113 - DNA, 581 bp, Homo sapiens
ctggaagggttaagggacttcaggttgggaattgatattcaaatttttattggtgttgagtggaaattctggttgggcaggattagtagtggtgtattctatttattttttatttttatttttatttttgaggcagggtctcactttgtaacccaggctggagtgcagtggcgccatcacggctcactgcagcctcgacctcccaggcttaggtgatccttccacctcaggctctccagtagctgggactacaggcacgtgccatcatgcccagctaagcttttgtagagatgagatttcgccattttgcctaggctggtctcaaactcctgacctcagatgatctgccctccttggcctcccatagtgctgggattacaggcacaggtgagccactgcacctggcctggctgtggtgcattctgaatagtaaattttaacaatgaagaacacttaacgttaggtattttggattgactaaaacaagtacagagcactttccatgtttaacctgctcgtaaaaagacctgtatttctatggagaaggaaagaacaaatgaaaaggtatgtaaacttctttt

SEQ ID NO: 391114 - DNA, 732 bp, Homo sapiens
cattgagttactgatcaacagtgagcaatggaagctgttcaaacagaaaggaagcccagccgtgaggtggtgctgccaacacactcctttgaagctcggctggcccctgtggggagtgcaggaggctgggggtctactccctacggttcccagagaaatggtagcaagaagacggtgttatttctaattggatgatgaaagtcagcctaggggacagagaccaaagggccatacgtaagaagaggaggaagtgaaaacatctgaatcaaaggttgaggtaaaactgagagacagtgtttgcagtgaaccatgcagtaaccttcatcttgccccctggtcttcaggaaacaagcaagtggggaaggaccgaaagagggtactaaatttccaaatgatcagacgtgaagtttcatggcccataatggctacacatttgaagactcaagcaaataaattagaaataaagcctaccagcaaaccaaaagataattacatgtaaaagcaagtctccttgatttctgatacttgcacttatgagaatgagaaaacaacgatagcacagagagatggtggacatggaggacaggtcctgtaggctcacttcatgggctttttcataccctgaccactttccacgctggattcattttactgtagtgaaacaattggctgtagataatgttaaaagataggactttggtaacaggagaattcatggattcttgaaattcc

SEQ ID NO: 391115 - DNA, 703 bp, Homo sapiens
aaaacattagagtggtgaagtagcttgaccaagactgcagaaagagcatatcctaaagccataattcaaacccagatgttctgacagttaagatactttaaaataataataagaaaaatagcaataacacaataacaataactagtgtcaggcaggtttatgttgttgaattctgtttgcttgtattttgctaaggagttttgcattggccaaagggcagtatttaataattggtgccaggaaaactggatatccatatgcaaaagaacaaaactatatttcattttttatcgtatacaaaaatcaaattaaaatggattaaagtcttaaatgtaagatctgaaactatgcaactactagaagaaaacactgggaagtgctgtaggacattggcctggacaaagatttttttgggtaagaccttaaaaacacaaacaataaaagcaaaaatagacaaatgagaatatatcaaggcaaaatgcttctgcacagcaaaggaaacaattagccaagtgaagagacaacccacaaaatggaagaaaatatttgcaaactagctatctgacaaaggattaattaccagaatatataaagaactcaaacaactcaataccaagaaaacaaacaatctgaattaaaaatggccaaaatacctgatagacatttctcaaaaaaagacatacaaatggctagcaggcatatg

SEQ ID NO: 391116 - DNA, 284 bp, Homo sapiens
ctaatagtgtcagctactcaggagtcttaggtgggaggattgcttgagctggggaggttgaggctgcagtgagccatgatcctgcccctgcattccagcttgggtgacagcgagatcctgtctccaaataaacaaatcattacctgctgaaatagtcattcccagtttatataatcagatagctagagggtaactatagacaagaaagcctgtggtttaatttgataggaaagactctaacctcattgagagaaaacgatcagaaaatattccttttctaatgg

SEQ ID NO: 391117 - DNA, 716 bp, Homo sapiens
atatataaaaagggaacagactctggtctgcccagctgaggcttgcttcatattacccccgaaatttaaaagaacaaaaagaagataatgtggaaagagatggctaaaacaaaatgacccaatgtgaatttctgaagaacagtgatggacacactgcggtacatcgtattattctctccacgttcacatctgtttgaaatgtgatccataatctttcatattaaaaacagtcaaattgaacactagccctaaagaatagcctctgatgggttccccatacatttgtctaggatcgataagggttaacaagggctaagagagtgagtgtgtgtgtgtgtgtgtgtgtgtgtatgcacacataggttttagaatagtgcaaaagcatgcaacagaatcaccaataaacagattctggtccctagctccagggattctgatccagtaggttcggtgtaaagcctgagaattagcctttgttttcttttctgttttgaggcagtcttgctctgtcgccctggctgagtgcagtggtgcaatcacgactcactgcagcctcaacctcccaaactcaagcaattcttccacctcagccttccgaacagctgggactacaggcatgcaccaccacacctggctaatttttgtatttttcatagagacggggtctcattatgctgcccacgctggtcttgaactcctgggttcaagagatctgc

SEQ ID NO: 391118 - DNA, 551 bp, Homo sapiens
gggtgggcctctcaggttgaaggtatggcctgctctggccatggagaagggaatgggggaacgaggtcctgcaaggccccctgtgtcatggggctctcaaggcaagaacaggatggagctgggagacaccccagctgtccagatgagagccagatggcctagagagagttcagctgtggccacagctgggagccagggcagaagcttaagacacagtggtaggccgatggattcaccagacaatccatcagcggttggggattttcttggaaaaagcaatcgatccttagtctgcattgccttccccccatttcctgaacacctgctatgcacaggcttcatgctaggctcagtaggaagagcaataaaccagatttgcacaccctggttggtgaggcatgcctggtggctcaaaataactaagccaagacagcttaagtgttcttgagcagagaggagcctcatggcctgaagctgggtgctccaggaggacttcctggagtaggcacaactagagtagagtcttgaaggaagggagacacaggctggag

SEQ ID NO: 391119 - DNA, 736 bp, Homo sapiens
gggaggatttcttgagcccaagagttcaagaaatttcaagacagcttctttcaatttctgtagctatccagttgcagactggtgaaatttgcaaaccattgttaaccacagaccacactttgagtagcaccaaagagaggcaacagaacagaatgtacatatgtggtccttagagcaggacagcagaaggcagaaaaagaagattcttttaagcaaacaggtaataatgacatcatcagtaactacagttactgatgtagttctctactaagttctctgtactcaatcagttctctgtactaagatatgggtaacccggggcagtgcaagtgcagaggaggcacctaggccagcctgggtatcagggaaggcataagacaggtaggagttgggtgggggaagcattagtgacgagtgggaaggacactccaggcagagaaacaagttctggagtcattctgcagcatatgggttagaggatgacctttcctgtgatttgatggctacttgtctctgcgcatcagcattagtttccatgtgtataaaatggatatgataatcctttctttgaatcacaaaaagataaagcatgagatgtacctgttataatgcctggtgcttgctaatattgctgttctgtgtgtaaaagatacaggagtcagagctgccacagacagcgagttacagcactttgcaggggacagctcatggacccaggactggagcccagaatgac

SEQ ID NO: 391120 - DNA, 234 bp, Homo sapiens
ttatacactgctgaggttctggccacatgctactccttgcagttctggctctcctttggaacacttgaattattcatgacacacagtgccatcactacacacaggcaagtggggctgcagcccggcacaaacaaaccgagggcctttggtgtgagaatggcagttctgtggctttaagaaagagctggtgcaccacactgcagaaagcctgtagattcagctgtacctcaccat

SEQ ID NO: 391121 - DNA, 448 bp, Homo sapiens
aatcatgagtgacttctcgtgagatctggccactgaaagctatgtcacctccctactctgcgtgttttcctcttgccatgtgagacaactcactctttctttgccttgtacaaagattgaaagatttctgaggcctcccagaatcagaagccctgtgcttcctgtccaccctgcagaaccatgagccaattaaacctctttttcaaaatgaatcaaacagaaaatggcaaatgacgattgcagcattgctataaagatacctgaaaatgtggaagcagctttggaactaggtaatgggcagaggttggaagagtttggaaggctcaaaagaagacagatgagaaaatttttggactatcttagagactggttaaatggttgtgataaaaatcctggcacaaacatggatagtgaaggccaggctgaggaggtctcagatagaaataag

SEQ ID NO: 391122 - DNA, 333 bp, Homo sapiens
gagtccagaggccagagctctagttagctggagacctctgccaagtcaccaccttgctgaccctcaatgtccttctctgtaaagcgccatgatacctgctctatctcacagagtaactatggagatgacatgagagattgaaggcagccatgatctgcaaactatggagccttatgtaactacacgtgatgtgatgtgatgtaatctagctatattatctctaaggaactagggaaactgggagtggccaagagagtcactccttatctataagaaacacgtgagcctatggcctatcccagggaacatgggtcgttataggggattaaaatc

SEQ ID NO: 391123 - DNA, 275 bp, Homo sapiens
cgaattaactctccagtgtgtctagaaggataccagttcttcacttggagaactgaggaaatagttgttcttgagtgtttttgttttgtggttcaaatgagaaacctttgttggaaaaggctgctggggtccttctgaatagtcaagtacataaactatctgctatgtctatcatgctaacacatgatactgatcaagtagttacataataatataattgattttgttaaagttggtttacttaaaacattttgaaagggagatgctcttcatga

SEQ ID NO: 391124 - DNA, 398 bp, Homo sapiens
catgaggagtaggaaagcctcatctacctggctcctctcatcccacactcagtcatttactctggcagctaatggctgccacgaggggcagctgtggctctgagcattgctctttgcccctccatatgggcaggagagagcccgtgtctaggacagggactgccgcagcctctctggccatatttattgacagctgttggtgtctggagtgagtgggaagaggcagggaagccacaccgtgcccttctagagaaggaccaaatgccctcttctgatgtggctgctgttgagcttcctgtttagggggtgaaacagggagtggcaggaacacaggccgagtttagtgtggcctaggagatgccattgtcttgggggtttggccagactgccagccctgg

SEQ ID NO: 391125 - DNA, 436 bp, Homo sapiens
ccggacgtggaccactgccgtatatcggatagcgaaataaactcacgatggattaaagacttcagcataagacctaaaaccataaaaaccctagaagaaaacctaggcaataccattcaggacataggcatgggcgaagacttcatgactaaaacactaaaagcaatggcaacaaaagccaaaattgacaaatgggatctgattaaactgaaaagcttctgcacagcagaagaaactatcagagtgaacaggcaacctggagaatgggaaaaataactgcgatctatccatctgacaaagggctaatatccagaatctacaaagaactttaacacatttgtcaagagaaaaagtgaattacttagcaattgaagagtgataaaaccactgataattttacaaatcatgaattttctttggtaattaaagggatgac

SEQ ID NO: 391126 - DNA, 591 bp, Homo sapiens
ggattggggaaaatagaaacgctagagtaaaaaattataaagtatgcatgcgaaggcacacttatacaggcacattgtctaggtggtataaggatcaaatggatatgataacattttgtagcattgtaaatgttcacaaatgtgagggttaccttgatatgaggtggagagctgattcccaatctcagctctgatcctcactatgtgtcctcatttataaaatgaaggtaataatacaccttgtagggtcatcccaagatcagacacaggaaagcagatgagcccactttgtaaactaaattactatgcaaatataagccatcacaaaaaaggttggctcaggagagaggatatacttattactctttcataatttaaaaaataaaatacccaggaccgcaggacaactcggttaacatacatttggctttctcaaatcttaccattttagaagcatttgcaactgcttataaatcacttctcaaaattgccctgagctgaaatgatatttctaagcgcatgttaaaagcctataagtgcttctgttcttgaacaaagtgaaatcagtttacgttaatagaagtattaatt

SEQ ID NO: 391127 - DNA, 412 bp, Homo sapiens
cacaacaaataatggcagttggagaatcacaagaaatggtaaactctgcctgtagtaactgctcaaattgccaaaaaaatacttgagactagacagacctattctcatatacccacttattttcctccctaaatgttcacttagaaattacctagtttttgtcttagcagtcagctttccagagagttgatttgactgaagcaaattcttggctactagagatctttgcctgtgggagatttgagtggtgtcagattgtaaacttttctggagcctgcctctggagttgttccacctccacgccaccccaccacgtgccccatgaccctgtccacagagagcttgcgccctggccacaagcagcctgcactcgccttacagttacttcctttgttctcatggtctttcttgt

SEQ ID NO: 391128 - DNA, 687 bp, Homo sapiens
ggtctggaagaagctgtttccctaaggcgtgttcgggtgtgatttgtgtggggggctgaaagctactgcatgaatcataatggctcattgaaatgtattgaccttgctttaaatccagggaccggctcccaaacacactctgaatgctggtgagactgttttagaagctaagatttgcactcttgagtataatactactggagtttgtttttatccatgttttataatcattatgtacgtgtaaaggcttcaacttttacgtttaaatcttttccatggaccttttacatgagtaaaaaattactgtgcctaggaatatgtactgaaattcagttgtatgtcattttatccttaagtgaggcatcaagatttcatggaaagcacggagctgagttgtgtgactttaagtgacttaaaccctgtgcttcagtttcctcaactgttaaaggaaggataatatgcctatcttttagagtacttgtaaggctaaatgtcacaacagaaatggtacagaggaagcattcagtagaggccagctcccttttattaagatgcaattttcagaatatgtagactggcttagatgaaatttgatcaatttatttagttgctcttctgcgtttgctaaaagtgcagtggtgggtggcatcacacagtggtcggagtcagaactggcttttgatacca

SEQ ID NO: 391129 - DNA, 411 bp, Homo sapiens
ttttgcaccaccttctatggttttatatttctggtagccttcaggatcttggtgtttattcctgattgttttgtgtgacacctagtggtaagagtaaggcacaggcgttccttgatttgtcatagtgccttttgcaaaaattgggaggtgctgagccttgatgacttgtccctacagtggagatttccaaggaggtacctattgttttcctgcgactctgggaaacagttttgaataatgtgatccaacaggttttctccccatcatctatagcgctatatggtttaagtcaacaaacattacaacgtgggtgaaaaagaatatacacttggaaattagaaccatgagcagactgggcagaagacaacaagagggtctggttttgatttagaaagacctttatgggccagg

SEQ ID NO: 391130 - DNA, 524 bp, Homo sapiens
agaaaacgttattaaaattttaaagctctaaataataaatcatcaaggccaattagtagagttagaaagaaacttgatgattgtctggctcaattctctgattctctgtacatatagtaaaattatgtccaaaaagatgaaataatatatggaaagttacacagttggttaaacccctcccatcttctaaaggtagtgaggaaaattcagaattagctgtatatgcaaattttctctctcttatcagtcaacaatttagacaagttttctagtaagaagggtatgaggacagacagaggcttgctttgtacctgctgtgtgctagggacacactcttgcaagtgatttctgtcctaatagagctgggggtcacgttctgttatgggagagcctataaagcatgatacaattaataaaaataatagctttatttgagggccttcctgttctacacactgtgctttttgagaggtgatggttgtttgtgagattcagtatctgggataataagataggcgttgaaa

SEQ ID NO: 391131 - DNA, 325 bp, Homo sapiens
tgggcacctctatgtctcagtcatagggctaagctctgtttatgcattatctcatcctcatgaaaacctttgagggaggtactattattaagcccattttacatgttagaaaactgaggttagagaggataagttacttaaggtcacgcaattcgtaagttgtacaattaggactcaaatttgggtctgtttgatcttaaagttcatgctcttaaatacttcatcacactagctcctctgggggctttgggtgtcctgggatttggaggtggcggcgcttcagggtcagtcactggattgcttttcggctttgctaaagtcctgt

SEQ ID NO: 391132 - DNA, 173 bp, Homo sapiens
acattttggaagccaaggcaagaaagtatttcagtaatgagggagaggatggccataataaaaaaggtagacagtaacaagtgttagtgaagatgtggggaaactggaacactcatacattgcttggtgaaaatgtaaaaatggtatggccacttggggtttttgtttttttg

SEQ ID NO: 391133 - DNA, 720 bp, Homo sapiens
tgccgttcaatcccaggtcgttttccctttcagctgcaatgccgggattttaaatagcagagatgaaaggcccctgcccccgcctccctcctcccctgagttcatgtattatgaatgaaacggcagcctcgctgcttcctgaggtgctccacttcaggctggggtgcaatggctcgatctcggctcagtgcaacctctgcttcccgggttcaagtgattctcctgcgtcagcctcccaagcagctgtgaatacaggttggagtgcagtggtgctgtgtctggagtttgttcctgccgttgggtttgtggtcttgctgacttcaagaatgaagccacggaccttcacgtccatcgccttggcttagtgcatgtcaccaaaaattctccaggaatttcatagtttggaccttggtggcatggctggccctggattatccatgcagggaggcctgatcctgtgacagctggctgcagcagggggctgcccatcttctgtgctttgtggtacatatctgtgtcaccaaagtagcggcctcggtacagcaagcctttcatctgctgcttctccgtccagcagttgttccagaggttggcgatataatcatctttcacattcggtttgactgtttggaggctggagcctgtgtactcctcggagaaaatgcctgccacatagtagatgacactcaggtggtcagtgactcgcctgtgatgtggccc

SEQ ID NO: 391134 - DNA, 435 bp, Homo sapiens
agtatccctgtaacagtgttcattttacttacctgtgttataacacttcgttgactggaatgaaagtgattaagttagtgttaactctctgggacttgtgagtagaagagaattttgtgtataaaaactacctatcaggctatctgaatggtcctaattagagacaaatactgccacttaaaacttacccagtgttcatctaattaaatgtaaacttttcatatctcatcatacttttctaatacataaattttttaaattacctggcaaacaaaaatattttcacaaattaggaaagtattgtctagctttggagtaagagagcccttctttagcaagacaggaaacccagaagccattaaaagaaaagaaacacctttgaccttagcaaaaagaaatagtggttataaaagatgaaattaaagccaggtgcag

SEQ ID NO: 391135 - DNA, 384 bp, Homo sapiens
gtcctggctgaggtaccttctaggactgaagtaagcccccagtgagatgggtggggctgtaaatgttaccgctgtgaaaaggccttaagagatgatttcttgtctcacattacagattgggaaacaggcctaaacgaattagtgcctgagctaggataagaactgctagtcagagcaatccactttaccacactgcccctgacacaaaatgactttgagttgttgggtgtgttagtcttggatgttttctgtgtcatgggatcagatctcaacaattgtgaaagattcctctgacaaactgactggttttgagcagtgtctgaaggctctgactgactgaatgaatgatactcttactttgagaaaggccaactgttgtgtgtc

SEQ ID NO: 391136 - DNA, 364 bp, Homo sapiens
atccaaagcccagatacactgacctccccaatgctatccccaccccaggcctagcaatgctccttgctgatcccatcttcccctaaagtagtctcacagtttgcatgaaactacccaggtccaagcaagactcaccatgaaaccctggtgagtttgtggagatgcctcaccatccatctcatggccactctcccctcaaaagcccttccttatactccacaggctgcccccaacataacacacaaacatacacacacatatgcacgcacgtgctcacacacaccctcatatggacacatgactacatatattcattcccacacacgtatatgcacacacatggttacacagcctcatacagaca

SEQ ID NO: 391137 - DNA, 254 bp, Homo sapiens
gtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaacttaggttttgaaaag

SEQ ID NO: 391138 - DNA, 285 bp, Homo sapiens
cttcaaggaacagacagctatggactgcctccctagaaaggtacatagtcactcagttttccattcagtttcaaggggtctgtggatcccggtggcgaacttagccggatgcccatgctagaccatgcattctaagcctctttgtcgtggcttgtgccattttctcttatatctttgttcctttgtctttgttcctgtgtttccatcagtatttttcttcagtgcactttcctgtcagagttaatttttccctctatcgtgcttgtacagcacattaccagaaca

SEQ ID NO: 391139 - DNA, 432 bp, Homo sapiens
tgcctcccgcacaatctgccttctatgcctgccccattcagctctccagccttgcagcccctcatgagtgtggctgcagacatgctgtccggcccctccctgtgctgctgaccccctctcatgggtcccccagtgttccgtccccatccctgagttacggagccgcctgccgatgccccgcccatccctgactttgggtctcctgctccccgccagcacctctgcgctaaccacaccctctacctgtaaccacctctcctgtccccagcccttgccctttctccatcccatggccatcatcctggtctatgcattcatctctgctcgcccaggagccagtcagttacaggggtcacactccagaccatggtagttcaggagcccagagagagccctggagacaggccgggtctgggatctgggcctcgatgg

SEQ ID NO: 391140 - DNA, 327 bp, Homo sapiens
acaaatatttactaacatctcttcaaggctaggtggagttccttgccttggaggtgaataggcactaaactgatccacatgtggcagactttaaaatgataagttcaacgaagaaaaatgaagcagtgaacaattgtggggagtgggagccattttagttaggaacattagggaaagcctctgtaagagggtgacattacagcagtgttagttttaatagaaaacataaattttcaaacatagggactgttgaataaattctggcacatccaggcaagggaataaacatagcagttgaaatagtaacaacataacaatgtttttctc

SEQ ID NO: 391141 - DNA, 464 bp, Homo sapiens
gtagctccagctactcaggagactgaggtgggaggattccttgaacccaggaggtagaggctgcagtgagctgagatcacgccactgcactgcagcctgggtgacagagatcctatctaaacaaacaaacaacaaacaaaccaaccattgttttgggaggaagttaagttataggaaatggctgaaagttttatctatttgtggaactagaactagacagagtgactctggatttgtctgtttattcagggtgcaaaggggttttgtttttgtttttcttttcctgacagagtgatgttatgtacatgcctaatgatcattgcagcaggggaaagtgtccttttagttttttcaagtctgataataatgctaataacaacgacaactattccttattaaagaacttctgtgtgccaggtcctgcttaaggtgttttaatatacaaggtgtccataaaatccctg

SEQ ID NO: 391142 - DNA, 362 bp, Homo sapiens
catgtgcgacctcaggccaattgaggggacagagaatcctgaggaaagacagatcacagagggctagaacggtcagatgaaggcttaagtgagtcataaagaggaacgaacacacagaaaacacaggtaccaaggaggcggagcttagctggggacccaaaacactttggcatgaaatgacaagaacattaaaaaaaaactgatgcatttagcatacaacaatgtattacttcaaatccctgtctgcagaataaaggtgaaataaacctaggggttatcagcgcctaatgagaatctcctaaaactggggaaaagaatcaatggttccattggaatccacccttaagtgactcaacagccac

SEQ ID NO: 391143 - DNA, 373 bp, Homo sapiens
taggtgaaaagccacggcaagtgggtcgactcggacggataccggtgcggctgccccgggaggtgtcgcagttcggggactcccttcgcactggtcgcgaggcaggagggagcagggtgggaggcgagtcagaggagggtgacttacctgaagaatacaggttggtagcctgcacacctgaactcaacgctggcgggcgagaaaaccaagcagcgctacctccaagtaagggcgctcccctggagaaatgaatgcctggcgagcttctggagaacccactattagggctggaccctgcgggagggatagtgtcagctcccttccccttcgcccttttttgtccataggtaggcttttgtagggctctaaccag

SEQ ID NO: 391144 - DNA, 528 bp, Homo sapiens
atttttaaaaatatctttatctcttttgatttctttccaataagctttttgcactttaaaaatgtagtagattccttctaaagtagggagtgccagttcctggtttcctgctttgttcctcttgcatcactggatctcctctcccttcaccatttgccccaagcccatttttggtatctctgccatcttactattgttttttttttttttttttggaagaacagagggctcttttttaaaatgggccgagtcctggggttctctggaaaactctcctgtgaacccctcgtgtgaactccaaacccaacctctagagcctctccgcaagattagctctctttgttgtgcccaagactgtggagtgcagtggcatgatcacagctcactgcagcctcaaactcttaggctcaagcgatcctcccaccttagcctctctggtggctgggactacaggcctgtgccaccacgcctggctaatttttaatatttttattagagacagggtctcattatgttgcctagggctgg

SEQ ID NO: 391145 - DNA, 338 bp, Homo sapiens
aatagggcagtaatcataataagtaaatggcagagtcagtattgccattgcttggtggcttcattgatgcccctttaataatatttctgtagataaggagcttatagtttagtcagaccttattactacccaattctgtcttttatttttccagaaatggtatgttaagagtagatgtacctgtattcaacacatctgtttccacgtttgtttcttttttacttgagactggcaaataagattaaaccaaaagataaaacaggacctcattttttcaaaagggctgtgtttcagttatcctttgactaagggcagaggtaggagtagagagtatgtag

SEQ ID NO: 391146 - DNA, 362 bp, Homo sapiens
ggaaggtggagagcttgtagaaaggatacatttcctgcacctgtatgaaagaaactctctgcacacaagcattgctttatgattttgactttaccaatgatgttccacaatcccaagtctttaaccttcttctctgtgtgtgtgtgtgttgttttttcacaagctcttcaaggacatggacgactttaatttccagcataagacaaaccctaataattcctactcatattgatcccttcctacttttcaaggttcttttagttaaccaatctatatgtattctgtccctggatgttgtactgtagcaactcttttcatctgaaccagaagttacttatttagtttgatatctccagcaatag

SEQ ID NO: 391147 - DNA, 893 bp, Homo sapiens
aggacttcgagaccagcctgggcaacacggcaaaaccctgtctctacaaaaaaatacaaaaaattagctgggtaaggtggtgtgtgtctgtggtcccagctattcaggaggctgaagtgagagaatcgcttgagcctaggaggtcgaggcttcagtgtgccgtgatcgtgccacagcactccatcatcatcatcctgggtgacaaagtgagaccctgtctccccaccaaaaaaaagagggagtttcatctcccaagaaaatgaattagataggaataatagaaaatttactctcagaataatagggttctagctcctgcaaccaaaaaaagatagttcttttttacaacctgagattactttttcaagcatttctccagttccactggcattgaaataatagttagcaatgcatctgagcttttcttcctctaatgagcaggcagagaagtcatagatcatcatttggaggactataaaataagacatagcttagcaaaaggaccaaaatacattcagaggaggatgctattggtgaatgtcctcaaagcctataatctggaaaaatacaaggcatatctctgaaactgtgaggattagcaaactagctaacctgaatctctgtcttctggtagtataaactaggtagtttcaaatctgagtagtttctccataaaagcatttcttcccaaacgtttcttaccaaactcccaaataaatgagaaaaataaaatacagttttataatttttgagaaagattatgggattatggtatttaaaaagaaaagcattctgtagagttggggaaatctggaagactcttgaggacatagctttgccgaaattgctggttgtcacaagactcttcaaaaactacttttcatcagacatct

SEQ ID NO: 391148 - DNA, 446 bp, Homo sapiens
accatagcattctacttgcaggaatttttcctagagatatctttgctcatgtgtatataagttactcaatgcagtggtttaataaagcaaagatttgaaaaaaacctaaataatcaccaacatgggctggttaaatacatatgatatatccaaacataaaatgcatacaaaaaaaaaagaataatacagcctggcaccaatctgcagaatacattgtatgaaaaaggccaagtatggaggaatagaagaaataggccaagtatagaataggccaagtatagagatgcaatcatttgtgtacaaaaagagataaacagtgtcaatgtgcttgcttttgtatgcacagaggatctctgtaaatacaccccagacattgagaccactgggtgactctggagagaggttctggtgcttgggagagtgacatgggaggaagaatcttctac

SEQ ID NO: 391149 - DNA, 479 bp, Homo sapiens
gccagttttccgagcatacacaattgtgtagtaaatcaggggatgttgcgttgaagctgcaaaattggtgccaagtttgttatgcaggaatagaaaactaatatgagcacttacaacactgtgctctcattagctattgacataatagtttccccaaatatgggctccttagatttaggctctaattatccttgtaacctcagggctcttcatgagacaggtactccccaaaacgccatggaatgaaagtttaaattagacaacagggatgcagatcagaacctggatagattctgaccatttccatttctcaagaatgggcagacggatactgacaccaataccaggatacaaggaggcggccccccttcagtccaaagctctaagacctattctagaggcaaggcaagtaatccaggctcagctgccccatctgctgctccagccttgcttaagtggacttccctccaaggaacatt

SEQ ID NO: 391150 - DNA, 447 bp, Homo sapiens
gaccggggaaatcccggtggggcgctgcaaaattggtgccaagtttgttatgcaggaatagaaaactaatatgagcacttacaacactgtgctctcattagctattgacataatagtttccccaaatatgggctccttagatttaggctctaattatccttgtaacctcagggctcttcatgagacaggtactccccaaaacgccatggaatgaaagtttaaattagacaacagggatgcagatcagaacctggatagattctgaccatttccatttctcaagaatgggcagacggatactgacaccaataccaggatacaaggaggcggccccccttcagtccaaagctctaagacctattctagaggcaaggcaagtaatccaggctcagctgccccatctgctgctccagccttgcttaagtggacttccctccaaggaacatt

SEQ ID NO: 391151 - DNA, 407 bp, Homo sapiens
tcttttaaatagatacgtgatcatttaacacacgggtgttaagttcattcttgctgcaaaagaaggccattgtacctcctgaccctgaaagcaagatgaagtcactgagacaccaaaggttaattgcttgcccaaagccatgtagcaacttggttgaagttactttagtgtcgaaagctccacatatgtgcttttcgcaaaatcaatagtcaccccatgcaaacgaagagatggtaattagagatgggacagaccccaacatatccttcatttgaagatagaataaattcagcaagatacctaattattatcatcatctttcacaaaaacatatgtgatttttcccccctacccaaatgttttagtgaaaactgcaactgtgcattaaaaggcagttttgcatgcat

SEQ ID NO: 391152 - DNA, 761 bp, Homo sapiens
aagacttatttatttagtgtatggccatctcatttccaagagtcaccaaagaagtgagaatggattagatagggaacaagctgaccattggattagtttatcagatgattagcatgccatgctaatttatcaagacatggaacatttaaagaaggggagagtaacatatacagggaagataggagatctttgtcccaattatttctttttttttaatgcatgaatagtcttttggtaaatatagtttatgtttgtttctgctttctaagttaggctgcaaaatattatttatcggtggtattctttgaaattgattggcatggcaagactgtaaaagagtatccataggtgtatttaaaaataaaagatcgtcttttcatctttgcagaaaaacatgtatttactattgcttggaatagaaagcagaattttgctgtagccattaggaagtgacaaacactacgccataattatagtgagaagaaagcatcaaaaagaaatgttttggttttttttatatacagttggcacaaaaatgtccacatatatgaatactctaaagaatgcaccataaaaagaaccttccaccactattaacaggattaatccgtgctcattaccatgggattggggatacatttttacatgttcttgattagattcaagagccaaagaataaggcctaattgatgaaagtgggctctaattttgtgcttttaaaataatggcctctggccaaatatgggcaaaagaaacagcac

SEQ ID NO: 391153 - DNA, 306 bp, Homo sapiens
ctccctacctccaggaccaaatttcgcacatctatgcccctactgatggcattgccctctttgttggccttctggtagaattcaccagtggctccttaaggctgatctgctttttctacaaagctgttttggaagtactgcctcctagcataagaggaaggtagctaactatggagttgcatctgcaccttggataagctgaggtagcttgtagactactgtcttgtcacctggctgtcgggctagtcggggctgtcgggctagtcggggctgtcgggctagtcggggctgtcgggcagtcggggg

SEQ ID NO: 391154 - DNA, 216 bp, Homo sapiens
gtagacgaatcctcctcctcctgaaaatgtgacctcttaccttagaaagaaaaggaaataggatataaaactctatggtgtggcacaggtatgcaaaaaaaaactaaaaacaaaatccaaagcaaaaactgtgcattggcctggcacggtggctcacgccctgtaatcccaacactttgggaggccaaggcaggaggaggagaggaggaggaggaa

SEQ ID NO: 391155 - DNA, 299 bp, Homo sapiens
tatgtatgtatgtatgtatgtatgtatgtatgtatttatttatgtatttatttttgagacggagtttcgctcttgttgctcagactggagtgcgatggcgcaatctcggctcactgcaacctccgcttcccaggttcaagcgattctcctgcctcagccttcctagcagctgggattataggcatgtgccaccgcgcccggctagttttgtattttcaattgagacgggatttctccatgttggtcgggcttgtctccaactcccgacttcaggtgatgcgtccacctcggcatcccaa

SEQ ID NO: 391156 - DNA, 357 bp, Homo sapiens
ccatgatagattttttttaaataagaacttgaaaaaaaataagtcatgcataaaatctttggtcacaagagtgaaagatgtgtgcctgtacagctgttataactattttcatgataaatacttaccttcagtacaggaatttagcagcacactttaatttggatttgaaaagttaacataaattgtctgactttgacaatagctgcctaatatttcagttttgtaaactacttccaggttctaccttcaattctaccttcaagatgaacctagtggacgtattcatttttaaaagctatattccagaccctgtaccctaaaaccagtttctgacttgatgtttagggaattacatca

SEQ ID NO: 391157 - DNA, 184 bp, Homo sapiens
ttagttttagggggagtgagagaaagcacctggttgctccaggctgatcaactggtcagtgtttccagctactccttctgctctgaacagatcagcaggtgtttcttgaccttgcctgggttagagtttagctgagcggtgaaggcaaagggtacagaaacgtggcctgtggctttgaagattt

SEQ ID NO: 391158 - DNA, 252 bp, Homo sapiens
  misc_feature (10)..(10): n is a, c, g, or t
cacccccggngttgcgctcccgcccggccgtgcgctcggagtggtctatgcagagatacgatgggaagcctgtgacaatgtgattgcctcagaaatgagatagataggcaggtcagcgggaagttcgggctgcagccctgggcacagctgaaacaactagggagaaacccaggaagagaaccaagaaagcaggagcccaaagccacatgtttagaggaagacgatcagccatctctataccgttaggagcct

SEQ ID NO: 391159 - DNA, 644 bp, Homo sapiens
gccaaaaacaaattaaacctaaaatcactggaagaaaaataatgactatcagcaaataaataatactaaagatcaataaaataaaaaaattatatttttgacaagataaaattgataaattactaggtagtctaaccaagaataatataaaaaatattcaaataaacaaaattagaaatgaaaaaggagatattaaactgatactacagaaatacaaagatcatcagagactattataaacaactatttgctaacaaactggaaaacctagagaaaacagaaaattcctgcatacatacaatctaccaagattgaattaggtataaatagaaaacttgaataggccagtaatgagtaatgagaattaatcagtaataaaaagtctctaccctgaaggaaaaaccctggactggatggcttcaatgccaaattctgccaaacatataaacaagaattaacaccaatgctcaaactattccaaaatttgaagaggaggaacttcaccctatctcattctaagaagccaagattaccctggtaccaaaagcatacaatgacacagcaaacaaagaaaactacataccaaaatccctgatttacatagatgcgaaagttgtaaccaaaatactagcaaaccctataga

SEQ ID NO: 391160 - DNA, 331 bp, Homo sapiens
tactccctggactcttgaagtaatagaaactaaggaaatcatgcgtggctgaaatggcaaatctaccctttgctgactataaaactgttcacccaaactcagggtgcctacagccaccttaccatagtacaaaccctgcagcctctctaatgaacccagaggttgtgaaatacttccctaaagggaaaacaatggtacttggagcaagatcagtgcctaagggtaagaggggaagcttctggaaacttaagtaaagattcaaacagtagaggccagaaggaggggaagcttctggaaacttaagtaaagattcaaacagtagaggccagaa

SEQ ID NO: 391161 - DNA, 254 bp, Homo sapiens
aaaactcttcacttcttctctgctggaaaatttctactcattcttcagtatgtccagatcacatttcaacttctctaagaagctcatttaataagactaagtcagtcactcccacttctttgtttcaacagcactaccatttacttctactagagtagttaaaatactgaattatgactattattttggatgtctgtctccatgtactagaataaaacttcaacaaaaaataacattaggatacagtagggaga

SEQ ID NO: 391162 - DNA, 340 bp, Homo sapiens
tctatcttgttctatttataactgattttttttagttctgtatgtattcgttgaacatatttttttacttccaattgtttttccagatttcacttttcctctttttccataacccgtgaagatagttttaatttgctagttcattttttgctgtatttgaaaatgtaattatttaatatagaaggcacagaattccctgcaaaatcttacatgtttaaacaacatataattttttggtatctgaatttaggaataaatcattttaatgcatcttaaatcacgtcacctaatcataatagttgtggtaactaatcattagtgcagagcatgcagataaaaa

SEQ ID NO: 391163 - DNA, 412 bp, Homo sapiens
cctagctatgctgccttgaacaaatcactttacttcattgagcctcagtttcttcctctgtaaaatggggataatagtccctacctcagaggctgttgtaaggatccaatgagataatgtctgtggaaactcttaaaatcacaaaatactttgcaaatgttatttccctccagtttctcctgagtttgagttactgggggataaggctacatattaaactgatgtttgcattccttcaagccagagcctggcatacggtaggtgcccaaggactgtctattgaaataatctggccaactgattagagaatgatgtctacaaaagggcctggaggcataagggctaccaagaagagacgctatgacttttgtcctagtaattcatctactcctttaccatccttctcctcccg

SEQ ID NO: 391164 - DNA, 173 bp, Homo sapiens
aaaactgagcacaaaactaaaataacaggctaattcaaaactatttccttggcttatgcttataatcccagcactttgggaggccaaggtgggagaattgcttgagcactggagttcgagaccagccttggtaacacagtgagatgccctctgctcaaaaaataaaaaattag

SEQ ID NO: 391165 - DNA, 197 bp, Homo sapiens
tctgactaagtttaaattctactctttcttgctgcctaccttggcgatgttcttatatttatttcattttccattcacctgacaagcccctggcagtctctgtggacagttttgaagtcacctgcctggtcactgtatctcagactcacacacaggtaacagcctgggaaaatcactgatgagtgaaaggcccactt

SEQ ID NO: 391166 - DNA, 830 bp, Homo sapiens
ctcttgcagtcctgagctttgtcaacatgatcctcctgcctgagacttcaatttgggaaagaatgatatgaagaagccagtaatgcagagaacaaatgctggcgaaggtggtggagggagatttagctttcaaaggaggcagagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcac

SEQ ID NO: 391167 - DNA, 730 bp, Homo sapiens
agtggaaggagatggatttttagctaagacagtgaaactattccttgacatagttctagttctagcttttgccattttttttccctatcagagaagagtagggacctgtcgggattggcaggggtaagcagacaggtgagggttcctattttagagaagctacaggatttggtgcatactgaagctgactttggtgcatacagccactctttcaaatgttcctgaagacaactcatttctgctgggtattgagactgagctggtgcatgtaggtggacagacagttttaaacactactatctcagtaaagccaattaaagacatggaactggctggggttgtcctgagagcctaatttatggagcacctgcttggtgctggtgctgagctcaggatgagaggcagtggaggagtaaagagaacatggaaaacgtggtccatgcactctaaaacctttaaatatggcaggatcccatatgtccttttaaatagagccaggcagtaaaccgatagctaaggactgtagctgtggataaacaatagacaggtgacaaatactgatactggctacttttcatagagaacagagtgtgtgttcctggcactctgctgggtgctttatagatggcatttctaattaattttttgaaaatccccaaagcaggttttattatctctgttgtacaggtgaggaaaatgagactcagaaagcttgtcattggaagaactg

SEQ ID NO: 391168 - DNA, 538 bp, Homo sapiens
gtgtcaacttaatgactcacaggcattgtgggttactcaatttccagctacagttttgtgttttttgaactgatgatatcattcagccagacatttcctgacttggaagtttcctgatcccattggcaacaccacccaaatgttctgagcttaatcctttggaaaataaatggactccttgttcccactgagacctactcctatgttgaaacataggtttcaactcctatgttgaaaaccagggctaactaatttctaaagccagacagggcctaaattgctattttttgggtcaatgtctatctatactatttcctacctgttaaaagacctgtagaaatgcacctatataaaatataggtttattgttctttgtgtcaatggcatgtattattttggctattctagaaaagaaattacgttggaattccaatgtaaacatgtttgtgtgaatcagtaaccttctctttcttttgtatgtcataagaaagcaacaaatgagttgttaaatgctaaaattaaacaccatttagcaaaa

SEQ ID NO: 391169 - DNA, 367 bp, Homo sapiens
caggaatcagtagacatttgcttcatgtttggatggagaaatagattgctccaggataagcaggggtttaaaataaatgttaaaagtacagaacaggaaattatcaagcagaatatgtgcctgtcttcatgctgtatgttcatccagtgaaaaaatatgcctagttttatttcactagtagacctggatttcagtaggttgatttcatctgttagggatagaagagccggaaagaggatttcagtaggaattcacctgaccatgaggaaagtggtcaaggaatgaagacattggaggcataaggtcttcttctcttccttctggagatttggtctctcatgctctattcctatgacagtagtggtag

SEQ ID NO: 391170 - DNA, 702 bp, Homo sapiens
gatgagtggctggacgtggtggctcgcacctgtaatctcagcactttgggaagcgaggtgggagaatcacttgagcccaggagttcaagaccagcctgggcagcatagtgagaccttgtctctataaaaaataaaattagctgggtgtggtggcatatgtgcttgtagtcccagccatttgggaggctgaggtgggagaattgcctgagcccatgaggtcaaggctgcagtgagccaagatcacgccactgcactccagcctgagtgacagagcgagaccctgtctcaaaaacaacaatgacgacaacaacaacagtaacaaaaagaacagatggataatagaggcatagggattggaattgtaagaaaaggaaatgctagaaataaaatctataacagaaatgaagaatacctttgatgggcttttcagaagaacaaaataaatatttgaagtaataatgactgagaattttccaaaattaaacacctacacatatcatattcaaactgcaggaaaccaaagataaagagaaaattttgaaagaaaccagaggcgaaaaaacccaccttacttctatgtgaagaaagcaaaaattacatcggacttctgttcacaaacaatgcaagcaagaagcgagaggagtgaagtgttttaagtgttgaaagaaaaacaccaacctcgaattattctgtgtgcagtga

SEQ ID NO: 391171 - DNA, 141 bp, Homo sapiens
gaaccatggcctactgagctagatacaaaagaaaatgaagataggaggagatttatggacataggcaaagtggagggaccattggcttggaaatctcattgaggctggagaactgctgtagagagtacaacctgccggtgg

SEQ ID NO: 391172 - DNA, 342 bp, Homo sapiens
tttttttttttaggaaatcattctgtttgctatgcaggcagtgatctgtggaaagcaacacaagaagcagggaattaatcaggaggtaactgaaagaatccagataagagatgatggtgatttaaattgtggatttaatagtagtgatagagggttccgatttcaggatgtattttagaattgtgggattgctgctaatttgcatatggggaatgaagggaaaaaaggattggtgaatgaacctcaaattttcagagtgagctatctatctggtggatagtgatagaatttgctaaggagaggggccatgaagagttttgttgagaacatcgtgtctgagat

SEQ ID NO: 391173 - DNA, 591 bp, Homo sapiens
tttgagatgtcagcatcgcacgctttcaggcaaagtgcaacagaaggaactgtacttgtcattacaccaactgcctccttcccagtggagggtctttgatcctggtactatgactcactgggtcactaaggacttcagttgtccctccaccatggtgggtcttgggtttctccattcagtccagataacacatgtaaaggatctgaggtccctagataagaagcaacattcagtagaatttggcattcataggatgatgaaatttatgacatcattatcccagttctcacggttataatccacagaaagcttctctttattctcagaactagcccttgtagtggccttgaatgtgcaaacgttaccctttagtaatgtttgaggcagaatttgaaaatctgaaacatgattcaaagctaccctacaataactaagctgccatagttacctaaggctgcttcccaatatgttttctatgaatctgcctttccaatagagcacagtgcagggaaaaggggagggggcaattgtacaaaagacacaaaaggtccagttttagtttggcccatgactgccatgccctggaattct

SEQ ID NO: 391174 - DNA, 447 bp, Homo sapiens
agggggctttctgctttactgtttcagcgggaagtggtgggcaggggccggcctgagaaggggggtacgccaggcaggttgggatgtgaggacccagtgcacagggtccacccccgggcccgagggtcccagaatagtgggggccctgcagagagccccccattaggtccctcagcactcctgggcccctcatcaaacccctaggctcagctcagtagctggtccccaggagagtacagtgtgggggcccccgagagcacagtgtatgggggtccccggggggtacagtgtctgggggccccccaggaggatgcagcatgtgggggccccccaggagggtacagcgtgtgtggggcccccaggatcacagggtctcagctcctgggctcttggatttgcagcaccacgaccatcgcgtctggtctgttggaacgggaggtgctgctg

SEQ ID NO: 391175 - DNA, 333 bp, Homo sapiens
ggtggggtggggtagggagaagaatgtgggttaagaaggcaattcaggccagactaaggagaaatatttaaaaaggagaagagaagggagacccatttacattgtcagcaatggtattatttactctgaaaatgtgcagaatgactgaaggactggaatctgataaagggggatcctgaagccaagaagccaggagtctttctttgctcacactagcaattaatcctgaagatttagggcccctctgtgtatgggtgcagacactagctaataaacttgactgtttctttcttttgagacagagtctcactctgttgcccagactggagtgca

SEQ ID NO: 391176 - DNA, 417 bp, Homo sapiens
cagagggggctgaggagggctgcagggagatgacaggaaagccggtgttaaagtaggagtacttcccactctctgggcatgaggagaccaggaggacattccacagtgagaaacccaggcagaggccgtgtgcttatggcattgggggggagaatgacaccttagaattattctctacattggaattgtctattacagatacccatattgtagcttcacatagtgtggtggttaactgtgttatcatattgtcttatttgctattttccagccacccgcccatccctgatagtcactggcccagcacagggccttccaccttccatcaaacaaatgcctgagcttctcaccgaggggtaaatcacctgccagtagggaaggatccctgttataacccctctccaggcaggcttggtc

SEQ ID NO: 391177 - DNA, 415 bp, Homo sapiens
ccgagtagctgggattacaggcacctgccacgcctggctaatttcgtatttttagtagagacggggtttcaccatgttggccaggctgctctggaactcctgacctcaggtgatctgcccgccttggcctcccgaagtgctgagattacaggcatgagccactgtgcccagccttgctgctgatattcttatacatgtctcttggtacacatatagaaattttccctagcgtatggacttactggatcacaggatatgcacaccttcaactttattaggtattgtccagttttcccaagcatttggactggtttatacttccaccatcagtgcaagtgtcgtctccacaaaggcgctccttcttgcttcctcctagtataagtagctgttatgccacttatgaagaaatgtttgt

SEQ ID NO: 391178 - DNA, 747 bp, Homo sapiens
aagaatagagaaaatttatttatctagtatcaagatatatgctacataaatgatccaatccattatttggattattttaatttttatggtcaccaaatattaatttttgaaactttgaaggcataatagattttaggtataatactatttaaaaccccaaagaaatctaagctactttaggaaaactttctttttcatcttcagttatgtttcccaaagaatgaagtacagtttttcccaatttgtactcaaattatttgaatgtgaaatgaaaagttaattgtgtgaattaaaacacacactcatatcgttaatcactcaagcatgcattgaagagtctgtgaacggaataaaaatgatcccccttttctttgtttccactttttttgtagttttgacagaaccattaatgttgacacactagcacaatctgttggattttctagtagctacagcaccatggttttggagattcctcaattctaataacaataatggtggacagggttaatgtgccaagcactaagctacatgcttttcatgcatgacctaatacaacaattctatggtggcaggtactatgatctccattttacatatgtgcaaaatgtaggcaccagagatgtaaatagtcatttgatcaaagtcacacaatagtaaatggtaaggccatgattcccacccaggcctcactgtctccaggagccatgtgcagacaactgtggtacactgcctgtcaaaacacag

SEQ ID NO: 391179 - DNA, 436 bp, Homo sapiens
tatggtccccacttctcaggtgagggaaaaaaaacaatgcagagacttaaataacttccctcaaatcccacagttagtaaagattagagccagcatgcttagaaactaaactccagcacttctcttcttctcctacagcacattgaactcttgacagtgggtgtttgatcagcaccattgttgatatatatctctcaacactccctgagacaccaacattccatgcatatggagtaagatggtaatcctctgaaagccacttaggtgcttttggctaactggtgtggaaggtttgagggctatttagagttacatacttggtgcagtactggcaagaacctaacaataagctccctggaaataagagtcctaatttgtagcctttaccagtctctgtgatataaattctccaaccatggccaatttcaagctacca

SEQ ID NO: 391180 - DNA, 417 bp, Homo sapiens
ggcactgaggcaggagaaggcagaggaggttctccaggaaaagctctagggccggttcatggagcaggaaaaggacttctaatgcttaaagagagcagggggaattgcctattttttcccctttctctgttctattgcaccccagcacttaagcaatcctctggtggctgctgcaacagcagtgccactgcaagctgacaggagctcaaaaacatgaggagagggtccttcttccccaagcaagggatctgtggtcccaagaagggtagcaagaagccccacttcatcatcttttctttgtcctcctgctgcttggctctacatagggatggtcactggaagtcacagcagagcggggcaactacaggcccctgccttgtagccagaagagtcaaaaggacagccacagggaagctg

SEQ ID NO: 391181 - DNA, 929 bp, Homo sapiens
ggaataaaaatctagaaggtatgtgtaccttacaaactagtagagaagggaagtagaacaagaaacaatattcaatctgaaaaaaaggtaaagaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactactaaccaatagaaatgttgtatggctatatatatcatgtaaagttgactttgaggcagaaaacctgtccgagagagtgagggtcactcaatagttataaaaggaaggtataattttaaataagtgactacctgataatacactttcaaaatacattaagcagaaactaggactgcagaagaaataggtaaatttatcattattatagcttatttaaaataatctctgttaatgtgagaacaagcagaaaaaaattacgaaaaatatacgatgattttaataacaggacttacaagcctgctgtaatggacacgtatggaacattgtattccacaactaaagtagaggaggaacacttagaaaaactgatcacattctggtcaaatacagccagctttaacaaatttcagtggattggcatcacattacactttctgtttacaattccattaacttaaatagaaattttgtgtgtgtgtgttttggaaattaacatgtttatttcaaaataacttgtggatcaaagaaaaacttgtaatgatagcagtaaattattgtacacgacaacttatgtatagctaaaatgggaattt

SEQ ID NO: 391182 - DNA, 3779 bp, Homo sapiens
  misc_feature (2773)..(2773): n is a, c, g, or t
  misc_feature (3002)..(3002): n is a, c, g, or t
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctcccgtgagtgcccaccgcacttgcccatggtactgccaaggcccccccgcgcagggctcacagcctctctgtcccccagcagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagcccagtgatgggagctgtggcctcttcacccacacacagaaggatgccagtccctctgtcggtctgaggtcagcttcctggggctgccccaccctgagggctccttacagggtgctcctcacagccatcccatctgtacccccgggctctgtccaccctgctgctgccctgggcacagaccctgaggtctcagtcctgcctccagccaagtttctgcctggtgcccagtgattcctgctgggcaccccttcgctcactgcccctccaccatgcagcagccagacacacccacagcacccgcagacctctaggccgggtcccagacatggccttcccccaaaatacttcctgctgtcctgtctgtgcacagagcaagggactccccacctctgcgccctgtnctggtcatcatgggctctgtgctggtcaacccagcaagtgtcccgtttgcccaggagtccctggtgtcgtggcccaggtctcatggtggccctaagcctgccagccctgctgcccgccttgctgtcctgctctgagcatgggtgccaccctccagctcctgggcgtgtcacttctctctgagcctggggcctgcatgggcccccagccctccccagcctgcttgggccnctcctgctggcctccacaggccgtgagctgtcagtgtctcaagcaggggaagtgagggctgcctccaggcctccgtgtactgggtggacaatggcccccaaaggccgtcggcaagaacaccacctccaggacccctacagcagtgggctcaggacttgggcaccaagaggagagggtgggaagggctgcagagtcagggctgcacccaagaggagccacggagccggagccggagcggaggcccccaccgagggccccagggcctggcaggttccggaagagacagggccagcgggagtcattccctgcagccactagggggcagccgccacccgctcagcagccctgggaggcggcacgggcaggtgcgccttgggagggctgaggcaaagaccccgggtagaaaggcggcccccagctctgcgagacccctgccctcttgtccagtcccttccgagggtccgcaggtgagagcagcctgccctgcatcccaggctctggttccagggtccagggccctgcgctgccacctccctcgtgcttcagccaagaaaatgggggtgcaagtagggtgtttggggtcccagagacgcaggcgccgcggcgcgatcttcctgggcaggagggcagggctccccaacctgcctgagccggggtgggggtccaggtcccccacttgcccttgtgggaaaatccctgtctcagcagaatgggccaaggtcacgcaggtctccccagcacgtgttaatttggttaataaaactgtggatcaaggag

SEQ ID NO: 391183 - DNA, 2788 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctcccgtgagtgcccaccgcacttgcccatggtactgccaaggcccccccgcgcagggctcacagcctctctgtcccccagcagcgaccgagggagagctccccacgcacgagcaggtcttcctgcagccccccacctcctctaagccccgaggccctgtgctgccgcaggagctggaggagcgcaggcagcttggtaaggcgcccatgggtggagtgccctggggctcagatggtcaccaacggtggcagggtgtcccccaccaccctcatgctgtttgccacctgctgtccccgtgctgacgagttgggccacctacctatccctggatggcctgtgcctgatgggtgacggcccagcgcaggggccccaggagtgctgggcagcctctgagcaggtgggagaccactgggagcagctcatccctggcccctgctttgcacgtggcagagccctcctgcacagccagctcctcacccccgtggcgcgcacccccaacgaaagtggctgtgatgagccccacagccctggcgttgcccactccttctgccacgtcccagggcccacgggcccacatggtgtgtgacatcccagtgccccgcgtgcaggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391184 - DNA, 2299 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391185 - DNA, 2640 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcgggcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctcccgtgagtgcccaccgcacttgcccatggtactgccaaggcccccccgcgcagggctcacagcctctctgtcccccagcagcgaccgagggagagctccccacgcacgagcaggtcttcctgcagccccccacctcctctaagccccgaggccctgtgctgccgcaggagctggaggagcgcaggcagcttggtaaggcgcccatgggtggagtgccctggggctcagatggtcaccaacggtggcagggtgtcccccaccaccctcatgctgtttgccacctgctgtccccgtgctgacgagttgggccacctacctatccctggatggcctgtgcctgatgggtgacggcccagcgcaggggccccaggagtgctgggcagcctctgagcaggtgggagaccactgggagcagctcatccctggcccctgctttgcacgtggcagagccctcctgcacagccagctcctcacccccgtggcgcgcacccccaacgaaagtggctgtgatgagccccacagccctggcgttgcccactccttctgccacgtcccagggcccacgggcccacatggtgtgtgacatcccagtgccccgcgtgcaggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391186 - DNA, 1785 bp, Homo sapiens
atggcacaaagcagcaggaactgaggtgccagggaggctgctgggatggtggtcggagcaggtggaggctgggtagggagaagcaggcaccacctggagagtgggaggccctcgcgtgcctgccacatccaccggcaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggtaaggcgcccatgggtggagtgccctggggctcagatggtcaccaacggtggcagggtgtcccccaccaccctcatgctgtttgccacctgctgtccccgtgctgacgagttgggccacctacctatccctggatggcctgtgcctgatgggtgacggcccagcgcaggggccccaggagtgctgggcagcctctgagcaggtgggagaccactgggagcagctcatccctggcccctgctttgcacgtggcagagccctcctgcacagccagctcctcacccccgtggcgcgcacccccaacgaaagtggctgtgatgagccccacagccctggcgttgcccactccttctgccacgtcccagggcccacgggcccacatggtgtgtgacatcccagtgccccgcgtgcaggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391187 - DNA, 1992 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggtgagcacacccgtccccaggcaccgcccagcatgggcagcttgggctgtgtggctctgaccagcacatggcctcagacaggccattgatggtggtccagccctccccacccaccttgtggaaccccacggtgtccctcggtgcacaggttggatggatgtgctagtcaggcggggtctcctcagtgtgtggcccagctgggcctctgacctctgagcccctgccaggggctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391188 - DNA, 2016 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctcccgtgagtgcccaccgcacttgcccatggtactgccaaggcccccccgcgcagggctcacagcctctctgtcccccagcagcgaccgagggagagctccccacgcacgagcaggtcttcctgcagccccccacctcctctaagccccgaggccctgtgctgccgcaggagctggaggagcgcaggcagcttggtaaggcgcccatgggtggagtgccctggggctcagatggtcaccaacggtggcagggtgtcccccaccaccctcatgctgtttgccacctgctgtccccgtgctgacgagttgggccacctacctatccctggatggcctgtgcctgatgggtgacggcccagcgcaggggccccaggagtgctgggcagcctctgagcaggtgggagaccactgggagcagctcatccctggcccctgctttgcacgtggcagagccctcctgcacagccagctcctcacccccgtggcgcgcacccccaacgaaagtggctgtgatgagccccacagccctggcgttgcccactcctttgccacctccctcgtgcttcagccaagaaaatgggggtgcaagtagggtgtttggggtcccagagacgcaggcgccgcggcgcgatcttcctgggcaggagggcagggctccccaacctgcctgagccggggtgggggtccaggtcccccacttgcccttgtgggaaaatccctgtctcagcagaatgggccaaggtcacgcaggtctccccagcacgtgttaatttggttaataaaactgtggatcaaggag

SEQ ID NO: 391189 - DNA, 1128 bp, Homo sapiens
  misc_feature (146)..(146): n is a, c, g, or t
  misc_feature (148)..(148): n is a, c, g, or t
  misc_feature (153)..(154): n is a, c, g, or t
  misc_feature (156)..(156): n is a, c, g, or t
  misc_feature (160)..(162): n is a, c, g, or t
  misc_feature (165)..(166): n is a, c, g, or t
  misc_feature (170)..(170): n is a, c, g, or t
  misc_feature (172)..(172): n is a, c, g, or t
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacgncncgggnncnggcnnnganngccngnggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccagtgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391190 - DNA, 2530 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggtgagcacacccgtccccaggcaccgcccagcatgggcagcttgggctgtgtggctctgaccagcacatggcctcagacaggccattgatggtggtccagccctccccacccaccttgtggaaccccacggtgtccctcggtgcacaggttggatggatgtgctagtcaggcggggtctcctcagtgtgtggcccagctgggcctctgacctctgagcccctgccaggggcgggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcgggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391191 - DNA, 2485 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggtgagcacacccgtccccaggcaccgcccagcatgggcagcttgggctgtgtggctctgaccagcacatggcctcagacaggccattgatggtggtccagccctccccacccaccttgtggaaccccacggtgtccctcggtgcacaggttggatggatgtgctagtcaggcggggtctcctcagtgtgtggcccagctgggcctctgacctctgagcccctgccaggggcgggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgcacagtctgtctctgtccctgctgcagggggaccgccggcccgtcctgctgggccccagggggcttctaaggagccagagggagcatggttgcaagaccccggcatccacgtgggccagtccccggcccctcctcaactggagccgaaaggcccagcagggcaagactggaggctgcccccagccctgtgccccagtgaagccagctccgccctcatccttgaagcacccagggtggccgtgagggccaggatccctgcacgcctcagccctggctccagctggcagcaagcaccgagcatgccctccccacccagaggacctccgggcaatgcctgtcccgcctcatgctggaggctgcctcgggcacctgcctgcccattaaagactggtcagacctgtctgagccc

SEQ ID NO: 391192 - DNA, 1841 bp, Homo sapiens
ggcgcgggcactcaggagccgcggcccaggtggtgcgggcggccctagcccggctgcggagcgctgcgcgagcggcgggctggctgaccccgagggacccccagcgcagcgggtgcggcgatgatcctggaggagaggccggacggcgcgggcgccggcgaggagagcccgcggctgcagggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggccctgcggcaggccatgcggacccccagccggaatgagtcgggcctggagctgctcacagcctattacaaccagctgtgcttcctggatgcgcgcttcctcacccctgccaggagcctcgggctcttcttccactggtacgactcgcttactggggtcccggcccagcagcgtgccctggccttcgagaagggcagcgttctcttcaacatcggtgccctccacacgcagattggggcgcgccaggaccgctcctgcaccgagggtgcccgccgcgctatggaggccttccagagggccgctggggccttcagcctcctgagggagaacttctcccatgcgccgagcccagacatgagcgctgcgtccctctgcgcactggagcagctcatgatggcccaggcccaggaatgtgtgtttgagggcctctcaccacctgcctccatggccccccaagactgcctggcccagctgcgcctggcgcaggaggccgcccaggtggcagccgagtacaggctagtgcaccggaccatggcccagccacccgtccacgactacgtgcctgtctcctggactgccctggtgcatgtcaaggccgagtacttccgctccctggcccactaccacgtagccatggccctctgcgacggctccccagcgaccgagggagagctccccacgcacgagcaggtcttcctgcagccccccacctcctctaagccccgaggccctgtgctgccgcaggagctggaggagcgcaggcagcttggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcctaagacccaccagaagccagaggccaggatgccacgcctgtcccaggggaaggggcctgacatcttccatcggctggggcccctgtctgtgttctcagccaagaaccggtggcggctggtggggcccgtccacctgacccgaggagagggcggctttggcctcacgcttcggggagactcgcctgtcctcatcgctgccgtcattccagggagccaggccgcggctggcctgaaggagggcgactacattgtgtcaggatgcaccatcagtgtggagcactcgcgagtagaggatcctctaaccgcaaa

SEQ ID NO: 391193 - DNA, 344 bp, Homo sapiens
gacgtggggagacgggcgcaccaggggccctgtgtgtccagacccagccagggggcgtggaggggctcccaggtggctccggtgccgcatgctgctggccttcgggagtcacggctgcccagggccccactggctttgcctccccgccccccatggtgctggtgcccatgggacttcccagggcagtgtgtgtgagtggggtgggccagggcggtggggcccagtggctcctgccctgcaggccatgcggacccccagccggaatgagtcgggcctggagctgctcacagcctattacaaccagctgtgcttcctggatgcgcgcttcctcacccctgccagga

SEQ ID NO: 391194 - DNA, 538 bp, Homo sapiens
tcattccaagccacagagataaatttttcaaaattggaaacgcagagacaagagcagaagagtcaatccacaaagacttgcagagtccagttttatcatagtcttatcagatgggccctcccttcttgggtgtagggctgagcacatcatctctgcagtcagactacctgggttccgggccaggctcaccagttcaactcattggctggcactgggcagttcacttctgcatctcgacttcttgacctgtaagttgggtataataaaccctatttcgaagatttgcggtaaggattaaataagattatataaagcacttagaacagtaaatggcaccttatcaatgctcagtgaacgtaagctctttttaacatcctcatcatggtcattatttcagtatgtcttccccctccactgtctctggatcatcgtgggtccatctgcttcttaatgcctaggctcagacattcttcctggatcctttcccctaagtactggaagctactaaagcaggtaccatgtttccccatggcagctc

SEQ ID NO: 391195 - DNA, 1092 bp, Homo sapiens
agtataacggtacataaggcgcgtctgcgtaactcaactttaattagaatgacaactaattgaaagtaatttaatgctagttcatgaaagattaatggaattcatgttttggagatgctgaatgcaacacagatttggcctgaaacacaaatctaacctttattcactttaattattcagtcagaatcatttcctgggagcaagtctagtctctggacggctctaatcaaacaccactgaactttgaagacatcaactcattcagctgcaactcaattttcaaattaatctgccacataacatggaggctttgtggcctaagcagggggcaggtgggaggggaagatggggttaaagccctcccaggtatgaactgattctagagcatctgaccttccccaccctctctagtggcgaggcacttccggaactggtgccaggtcttcctatgagaggctgagctgagcaaccacgctgcctccatgcttgagctcagggctccacactcacaactgaagcctaagcctggtacagctggaaccctgaagggggccctggaccagcagagcctgcctcttccaccctagcctagctgcccttccctgctctctccctctccctaggagagctgagacgagggacttgagctctctgcttggcaagatgccctcagaaaccaccccaatttctgcacccacttattccttggcccttcaggcaggcaccaggtacggcccacacagactcagcctctccttccctgccttggaaaacccaggtccctaactccatctgctttactttacagcccttccaaggcttcttcctaaaaccttctctgccaaaggggaggcaacgccaccatttctcacagcctggggcagcttggaatgtgatatttggagtcagcaaagattccaatctggctaatacacattaggcagtgtagagacctgtgctttggccctgaggcacagccatgtgaccatgactaatctatgtcatagacgaggtcagaacaagagaaggcaggatgtcccaggagggctgtgtcagaactcaaggaaaaaaatatgacctaaagaatgctct

SEQ ID NO: 391196 - DNA, 751 bp, Homo sapiens
ttcaacataagtaataaatatattcacattataaaatgagttctgaaagtatgcaagcatatacgttaaaaagttaaagtttgtttggcattacttgtgacactcccttcacatatttcttgctatgcacctacatatacaaatgggtacatgtacaaataccttttttctaacaaaaggattccaactgaatttaataattcattcatacatttatatattctttcaaaaatatttattgagtgtctacaatgtgccagatacttttgaatgagaagtggaaaaaaagtccctgcactcatgtgatttacctcctagtaggtagagacagcagagtaaccagcagatatatatctagtacatcagatggtgataagtactatggagaaaaataaagcaatgtgagtttggaggcatgctgttttatatagggtagccaggagaagctttgttgttaagatgacgttgagcagacagttgaaagatgagggagcaagccatgcagctgtcttggagacagacggtcttccagacagagggaacagcaagtaaaaaacccaaaggcaggaacctgttggccctttcaagaaagaacagagatgagcatagctaaaacagtgttgtgacaaaaagcagggaaatttcttagggaactattgctggaatccatatggaaggtggcgatagtgcagatcagaggggaactttgcaagagatagttaaattctgaatatattttatatgtattgac

SEQ ID NO: 391197 - DNA, 380 bp, Homo sapiens
cttcaactgacttgcaattctgtggttttagatgcttaagagtcctaaattcatattttcagcctagcctaaatttgacacatctttatctatctgcctactcaacatctcctctcagtcagccaataggcatctcaaactaaacatgttccagactgaattctgaatttccttctccacttgtcacaaatctactgctctcccagtgctctatattttattaaacgtgtattagttcgttttcatgctgctgataaagacatacccgagattgggtaatttatacaggaaaaggggtttaatggacttacagttccacatggctggggaggcctcacaatcatggcggaagacaaggaggagcaagtcgcctcttacat

SEQ ID NO: 391198 - DNA, 822 bp, Homo sapiens
gttcccaggaaaatgaaagcagttccttctggttttttcctttcatatgaaagtcatagttcccagcagatggctttcatcagccctgtacatgtatctgtaaattcaaggccaaggaattattttcaacttcattagggaacaggtgaagaaaccatttgtagtgtggcactattttattaggagttgaaattaagcatagagattatagtagtatgccattctgggtcaaaatagtttttaactgtcagcaatttaaagaaaaaaaaagactgctaaggaaaagtaagtctggctgtagtgttgattgaggtatcttttatggttgaattgtattatgcttacgaaacatagattattagaaaaaaagacttgtatcttctgcattgtgtagaatgttcagccagtagcaatcttggatcacagtgattctaatctgatttcacaaataatagggaaatttgagagccaaagaggttgaagtgtcttgtccagtgccacacagccagttaataccatctggaagaattggtcaggcccttctcaattttgtgcttttttcattatgctgtagtactgctttatagtattagagagcagtgagcctaaaataatttagttagaattctcttccttaatggaaaccatagaataaaccttgtctagagaatattggtggtatcgtaaaccacaaatatataaatctgctatttcagtgtgtgaaaatagctatacactcttgttagagttttgaaacaactttttgggaaaagactgctttcttatggcccaagttagaggaatcaaggttttcttatgttg

SEQ ID NO: 391199 - DNA, 177 bp, Homo sapiens
gctgttgtggaagacacagtaacagtaggaaccatggacagctgctagagtaacaggtgggacactgtcattgctgtaaaccatcaaaacagtggcaggagctgtattgggtagggcagctctgaatacttctccagggaatctcaccataatagcaacctaaagtaatcaaaagaa

SEQ ID NO: 391200 - DNA, 390 bp, Homo sapiens
tttctccgtctgtagccacaataaagggagaggatagatacctgctgctaactggaccaacctcatttactttggacatcagagcctgaggtgattacagattctggtcctaaaagaaagaccactataggatctgcacaagctaaccaaccatctaaagcagctggtacaggaaacaacataaatgtacaagaaaacaaaacacagagacccaaaaaactcctacccttgactccctcctgacttcttacagtaaattatttcataatttcctaagcatctgtatgatttgcaactaagaaaactttagagtagcaaacttgccacacaggttaggaggagaatgtgcctgtgaaaggctcaaaggaaacaaacagtccactgaagagt

SEQ ID NO: 391201 - DNA, 400 bp, Homo sapiens
cagactgggtggcagttgttgtgggggtggaatcccagagcctagtcaggcctcaagacccacagggccacgtgctgaatgaacacaagacagtcggtctaaagacttgggcctcagcagaaacccattttggaatctgtctgcctgtgtagcctggggatagtcagcttgcggtgggaggaaagagcatgaactctagagtcagacggatggattttggtctttcctcagaaagaaaccaactgttgagaccctgtcaaagagatttaatctctacttcttcatctttaaaatggagctacttctacttatctcacacagtggtttccttttttaattttaaagactcaaatgagataagatgcctataaaatatgggggaggtgttcagtaaatacca

SEQ ID NO: 391202 - DNA, 329 bp, Homo sapiens
ggagattcactgtgtaatcgatccaccctgtggcacagcagctctctccctccccgacagcccctggatgcaggccttcccatctctgtgttcctccccaaccacctcctgctgcccaagagctctttctgaaacacccccaactcctgtcaggcctcagcacccacacaaccgagttcaagtttctttgcatgtcatgcaaggcctgtgacaacctgacccgcagctctccagctctatccgccccgcagggcctttgtacaagccgctctccctctgggttcttccccacatgggtgggagctttcccgcccccatcagccatttcc

SEQ ID NO: 391203 - DNA, 922 bp, Homo sapiens
aggctggtctcgaactcctgatctgaggtgatccacctgccttggcctcccaaagtgctgggattacaggcgtgagccaccgcgtccagccgaacattgacatttttaaagagacttctattagttttatagaatgttccatattctgcatttgattatttccttctagaatgtcccaccttctggatttatctcattatttctttgtggtgatacttaatttgttcttttattgctgtatttcttgtaaacgcaaagttacatttaaataatggatttgggccaggcgcggtgcctcacacctgtaatcccagcactttgggagactgaggcgggtggatcacctgaggtcaggagttgaagaccagcctgaccaacatgatgaaaccccatctctactaaaagtacaaaatgagccaggcatggtaacgcatgcctgtaattacagctccttgagaggctgaagcaagagaatcgcttgcacccaggaggtgaaggttgcagtgagctgagatcgcgccattgggctccagcctgggcaacaagagtgaaactccatctcaaaaaattaaaaaataaataaaataaataaataattgatttgattcaggttaaatattattgtcagtaatacttcatacattgtttttggcttttcttgtgtatttgtttgcaaaaaaatgccatagacaaaacagctgataactaatgtgaattattagtcagtagtttattggttaatgtttttcttttttctttccctttgaggcagtctcctgtctcagcctcctgaatagctgggattacaggcgtgtgccaccacacctggctaatttttgtattttttttttttagtagagacggggtttcaccacatctctggtcatggtcatggccaggctggttttgaactcctgacctc

SEQ ID NO: 391204 - DNA, 489 bp, Homo sapiens
ttgcaccatctcggctcactgcaacctccacctcccgggttcaagcaattctcctgtctcagcctcctgagtagctgggattacaggtgcccaccaccaccctgggcaacaagagtgaaactccatctcaaaaaattaaaaaataaataaaataaataaataattgatttgattcaggttaaatattattgtcagtaatacttcatacattgtttttggcttttcttgtgtatttgtttgcaaaaaaatgccatagacaaaacagctgataactaatgtgaattattagtcagtagtttattggttaatgtttttcttttttctttccctttgaggcagtctcctgtctcagcctcctgaatagctgggattacaggcgtgtgccaccacacctggctaatttttgtattttttttttttagtagagacggggtttcaccacatctctggtcatggtcatggccaggctggttttgaactcctgacctc

SEQ ID NO: 391205 - DNA, 328 bp, Homo sapiens
cccatttgggtccctgggccggggcttcctgtggatgagccgggatcacacagcgatgtggggttgctcagggcgccccgttcactccagagtgacccctgacccaaagccagtgctgggtgtttgccgaaactgaaaccagggcaggtctgaatcagaccctgcagaacaatgaggccttttgtgcgaatgaggcgggggagggactggaggagaccaggagcttcctgacggggtccgcagcacaggtcacagcgattgaattcaggaggtgaccctcgaaggtcaggtcacagccgagcagcacaggcgctgagctaagtgtcca

SEQ ID NO: 391206 - DNA, 418 bp, Homo sapiens
cctgcctcggcctcccaaagtgctgggattacaggcatgagccaccacgcctggcctgttgtactgtttaaggaccaggcatggaagggagaaggggctgacctggtactgggggtttcacatttacatttatggattgcagcacccttatttgcttccagaaggcttatccttgcttagaaaggactcttccagtgggagagagataaatggctatcttcaatctccagcttgactgcttccctctctgcctctcactttccacaaggctccttctgtccaagggacccagttctgtgccatggtgtttgcttcctggcttgccctgcgtgacaggtctggctcctggcgtgaccgactggagagcgtctctcagcctagagctggggcaagatcccgagggcatgggtggctcaaa

SEQ ID NO: 391207 - DNA, 723 bp, Homo sapiens
gtgatcctcccacctcagcctcctgagtagctgggactacaggctcaagccaccatgcctggctagtttttgtattttttgtagagacagtgtttcaccatgttgtccaggctggtctggaactcctggattcaagctatccccccgccttggcctcccaaagtgctgggattacaggtgtgagccaccacaccctgacaaaagaattctaatacactaaaaatctcttttcttaaaccatttcactcatgaaactcttactttcctgtatattaaccataattgccagaaaattttctgctggaagttaaaatgatgttttcccctgaaatatcattataaaaccctatgaaatatttcagtgatatgaatcattcacttagtcatatgggtagacatttagataatagaagtagttaacagaaatctgtgagaaatatatattgttaattcctgtggaggaggaaggaagaaatcctactgaaatattttaattgtagttaaattcagtgttccctgccattttaaaatatcaagattattctgttctactcctttccttccaagaggatacatgaaataactttgataaaatcatgaatcagtttttgtttgctgttaacctcttctgtattctatttcatgaaaatagcaattggtggccaagaatacccttattcttatcaaccttgcactacataaatgagacattattaccaagca

SEQ ID NO: 391208 - DNA, 359 bp, Homo sapiens
caaggacagcccccctgcggccccctcgtccttcctaaggcaattttgcaggcagcttcctccaatcaagcatgcagccgccctgtgtgttcattcattttgcgtcagtggccatttcctccctcagcagtcaggctgcatctccatgaggggtgctccttctaggggagtaggcacaggaagcaacagctggggatcggggtcctgccttcctgcatctcccacgatgaggacggaggccgccgccccgggcctgttttgagcgccagcagcagcgaggcacccctcaaggaagcagcgccctgcagctcctttatctttttgcaaaagcgaatccgactctccctcaacgagccagc

SEQ ID NO: 391209 - DNA, 180 bp, Homo sapiens
ttccttcttctgcatgtcgatatccagttttcccaacaccatttattgaagactgtccagtccccaccgtgtgttcttggcagctttgtcaaaaatcaattgatttgaattgcgtgggtttatttctgggctctcttttctattccattggttaatgagtctatttttatgtcattatga

SEQ ID NO: 391210 - DNA, 187 bp, Homo sapiens
gcttaagaaaacgtttcctatcatgaattcatgagatattgtatattattaatagaagtctgttgcctatctttcatagttagctcttatagtatacttgtattgatgtttacatatattatagaaatcaagtttaacaatttttttcttctgtatttcttctaaaaaataaaaccccaaaatggta

SEQ ID NO: 391211 - DNA, 776 bp, Homo sapiens
cagacactgacttagggaaaatcattcacagggttgaatattttacacatgaaatttcatttggttctcacaacagccctatggaacggtttattatcccccattttaccaaccaggaaactaagctcagggaagttttagattcagagagtcacagagaatttaaactcagatctgtctgactctaaagccatgcttaattcatctctttcatcaaaaattaactcattgttctaaaaaagaagaccagaaaaaaaagaacaaccaaatcattattttagagcaaattggcatgtcatttgctatcattttcactcatcttgcactttctatcattcccttatcccaactcctagcttggagtcagctggggctgctgctttccttgcagcttgcctcatccctgagcaagctagtcacactgcctgggttatctgaagataatagaagacaacagagaaggccctttcaaaactctcgtcagcactttattttctgcatacaccttaaaaagagatagacagatgaatagctacagaaagcggagacaatgggcctgagttcaaacctccgcttctcccccttccagctcttggactctggacaaacacctattatgtgccagtcactgtgctatgtattttataaatgttatttcatttaaataaattgcacacttgctatgtagtgatatggaaagatctctaaatacactgttaagtttaccaaacaagcaatggagggaagagtgggcataatatgctactctatgtatt

SEQ ID NO: 391212 - DNA, 940 bp, Homo sapiens
ctttctatcgatggagaaaaccaagtgtaagctaattcatttggtagagaagttcaataccacttattgaatgcaaggcatgacacttggtgctataaaactgttgatgggattcccatatcaaaccatatgaccttcaagatcgcatacaagatagaagttctcgagagtaaagttttgccccctctatggctagatgagtgctgacccacttatacaataatttaataacagttttttgaaccccttcaatgtgttaggcatttctctgggtatggagttagagaaataaatgagtaaagtcatagaagggaactgaaggcatggggacagtaagaggaactctccccttagaaaggtgacatttgaaatgagtccagagtgactctggcatgaaaatcaagaggaaaaaacacccggcaaaggacataactggtacaaaagtttggggctggaaatacttgtgttccaggagcagacagaaaggaaagggaatgaatattggggaaatgcaacttggcctttgcgtatgttacgtatttagtctttccactccctctatgtatctagacttcacctgaagaaactggcactcatagggcttaacatagttgcctccagtcactcagctgatgagtgacaccactaggcctaggctcatgggctctggaagtaggaaatttgctgtcactatttcactagcctcccattgggtcttcccacgtcccacctctcccgggagtggagagagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtgaccaggccccagcctccaggcccccaactccgcccgttctctcccact

SEQ ID NO: 391213 - DNA, 819 bp, Homo sapiens
tgtcttggcacactggtaccccagcacccccaaatgtgcagtgtctgtgtgtacagtgggcacaccagtattgagtcagctgtagcacagatcggcatggggatgctgtactaagagtccgacccagaaaatgagttagaatttttctcttaaattttccactccctccgccccttacccccaccctaccccctcatcattttataaaacatatgtagccatcgcctgtaagatagattggccacgcacggtggctcacacctgtaatcctagcactttgggtggctgaggcagcctgattgctggagcccaggagttcgagaccagcctgagcaatgtgacgaaacccagtgtctacaaaaatatataaaaattagctgagtgtggtggcacacctgtagttccagctactcaggaggctgaggtgggaggatcacttgagcctgggaggttgaggctgcagtgagccaagatcatgccattgcactcaagcctgggtgacagagtgagaccctgtctcagaaaaaaataaataaataaaaagttatcttaacttctcccggacaccccatgttttactaacagggtcttctctggagctacacaggtagcaaagtcagtgtttgctaattgcaaagcacaaatcatttatctcagaaaaaaaaaaaaaaaaaaatttggggcgcgcgcccaaaatttaaaacatcttgggccgggcccggggaatgaaaggcaaaggtccaaggacaccggcagcagggggtcccaaaaaccgggccgcgttgcaccccaggttggctcggcacaggcagcaaccgg

SEQ ID NO: 391214 - DNA, 383 bp, Homo sapiens
tctgggttgcaatgagctggttgtactactgcactctagcctgggtgacagagtgcgaccctgtctctaataaaataaaaaagccaagcaaactaagacaaccaggtaattctgtttgtttcctgaattggcaaaaacttaaacgaaccgtgttaatatgtccaccttctgggggcagcctggctgcaggcaagagcagccctggagcttgcaccttccaagctgatcgtctacctctccaagcccggggctgtccacctctccaagcccggggctgtccacctctccaagcccggggctgtccacctctccaagccccgggctgtccacctctccaagccccgggttgtcttacctctccaagccccaactgtctacttctc

SEQ ID NO: 391215 - DNA, 230 bp, Homo sapiens
agcaagactccatctcaaaagtaaaataaaatataaaactccaacctgactcctccccctcaccagtgtaatcttggtgcctctaattctgttcaatgtttcccttttccattgtacccatcaccttttaatataacatataacatatttattaaatataagctctggcatggcacagtggctcacttgagaccagaaaattcaagaccagcctgggcaacatggttaaa

SEQ ID NO: 391216 - DNA, 279 bp, Homo sapiens
gatggagtctcattgttgcttaggctggtcttgagcccctgagcccaagagatcctcttgcctctggagtaactgggactatgagtgtgtgtaatcatgtccaacctctgccataaatatttctaacaaacttgattatattagctttctagtctatggtatcttaaaatttagaggtgtgagatgaattggtgcagacaggagaattagatataaaagccggtgagtatgggtgataaaacctaaaaagccataggaactggagcatgcaactcacac

SEQ ID NO: 391217 - DNA, 413 bp, Homo sapiens
attacttgatctcagctctgcacagaggagctgcccaagtgaacagttatctatgattatttgcttccaagacagagggccctgggcctgatccctggtggacatggagctgccaggagcatcctctcttctctgttcctccccttggggactctgaacttcccagggagtaacctgtgtcccccaggtcagtgggctcatgcactagtaattttttccatctgtcctttccatgctgagcctcaagtgaaggaggaggccctatcctcagctagatgaggctctgggtgctcggacctggctggtgaccaactccaggagtcatggcccttggatagctcacatccttgctcccagccagccctgcccaagaggccaccacacagccctggcacagactccccaggatcacc

SEQ ID NO: 391218 - DNA, 140 bp, Homo sapiens
cttcttttccttgcaagattagggacaaaatgtaaagtttatttgtgtaaattatcatttggatataaaaccagacaatgataaactgagttgtataatacctattcctggaaaacctctgattttgaagtacattattt

SEQ ID NO: 391219 - DNA, 375 bp, Homo sapiens
ctggataaatatactgagagttatcaggatacagatgtcatttaaagccatgggctgggaagattaccaaggatgagagtattgggagaaaatagcaatgatcccaggtgtgagccgtgggacatttctccatttagaggctggagagaaaaacaggaaacccagagagtgtagtaacctggaagccagtgaagagtgtctcaaggaagacagtgagcagattaggattgagatttggccatttggttcagcaatatagaaataattgtttgattgagcagatattctccccaagaatgtaaaatttataatttcaaggaattatgtgccatatcttagactatagtgctcaacattttaatagatgttagaaaa

SEQ ID NO: 391220 - DNA, 449 bp, Homo sapiens
ttaacatatttttatttcattccattccttccctcttttctcatcatctcgataatatgagactaaaccacaactttaaatgtcttctgtttattgaatataaagttggtttccctacagaatcaaaagttctaaaaaagaaaacttaaaaaaatttaagttggcattttcagaaacagaaaatcaattacggcatgttcctcacttctaagtgggagctaaacaatgggtacacatggacatgaagatggaaacagtagacactggggactccagaaggggtagaaggaaggaatacaaggactgaaaaactatctattgggtacaatgttcactatttgggtgataggttcactagaagcccaaaccccagcatcgcctattatatttatgtaacaaacctgcacatgtaccccctggatctaaaataaaataaagttggcatttta

SEQ ID NO: 391221 - DNA, 558 bp, Homo sapiens
atctaaggacagtactttgggtgaatactgtcagattcctggagggaaaaaagactttattcctcctcctgttgtggctgtgactctttggttttctagatcagagaataccgggaagcatagcacattaaccttgtgttccctctttaaatcaatatgcatcacccgttaggaaccaaagagtgtttggggggctttgaacacagtggtgaccaacactgtaaatctccctgctctcagaagtctccactctactgagagacaacaataaagaggacaatttcagcaggatcaactggaagatgataaactaaggcaaagcatagctctattataacacaaaaattgttgagatgttgccgatgcttttatacttaaaaaaaaaaggaacaatctaaattagtatgaagtagatgtttctagaagtgacaaatttttatttaaatctttaaatactttgtgctattattcttttgttgtcatgtggcttatagcacagaaaggaaagcttctgggacagagactttcctttgacaaacccaatgtagctattgaaca

SEQ ID NO: 391222 - DNA, 401 bp, Homo sapiens
tgtttatcgatgccacccaaacactctttggttttctagatcagagaataccgggaagcatagcacattaaccttgtgttccctctttaaatcaatatgcatcacccgttaggaaccaaagagtgtttggggggctttgaacacagtggtgaccaacactgtaaatctccctgctctcagaagtctccactctactgagagacaacaataaagaggacaatttcagcaggatcaactggaagatgataaactaaggcaaagcatagctctattataacacaaaaattgttgagatgttgccgatgcttttatacttaaaaaaaaaaggaacaatctaaattagtaagtaagatgtgtctataatttataaatcaagaaattaaacacgcatctgaacatcg

SEQ ID NO: 391223 - DNA, 220 bp, Homo sapiens
ctggtataatcacatgagtcctttcaaagcagggagttgtcttggctggtagtagaagaagtcagagacattggaggcatgagagagtgcagtcttggcactgatgactaggctggctgtgcttcttgttcctgccatgccctttgccttggttttgtctcttgaccttttccaagctgccacactctttactgcatcccagcctccagccctgtgccta

SEQ ID NO: 391224 - DNA, 781 bp, Homo sapiens
gcagttttagactccagtcatgttggacagatcgtctgggagaagagggaccatctgttccttatgtcccttttccctttcagctttttattttgaaaagtttcatacctactgatactctggaaaaattgtgcaattgaacatatacccttcatgtagattttctcattattaccattttattacatttgctcactcacattctttatgtgattttttttttgctagaccatttgaaaatttgaaaagtaagctacagatgttttgacacttcatctctaaatactttagcatgtacctcttcaaaacaagaacattgtcttacataagcacagtatcattacatgcaagaagtttaatattagtaaataacatatactttataatctttattcaagcttcctcaacttttttgcattttggcaagtggtggttctggtaagatgtctagagttcaattcaggatcatgcattgaatttaattgccttgtctctttatattccttaatctagaacagatccagtcgttacattgacatttttcgatgagtcttaatagaatgtttcacaatttgttttctcaccattttttttggagagacaagagtctcactctgtcgcccaggctggagtgcagtggcgtgacctcagctcgctgcaacctctgcctcccgggttcaaatgagtctcctgcttcagctgcccaagcagctgggactacaggtgtgtgccattatgcctagctaatttttgtaatttttagtagataatgggatttcac

SEQ ID NO: 391225 - DNA, 494 bp, Homo sapiens
ctggaggattaagtataaagccccatagcacagagcaggcgttcagcacctggtgccttatccccctggtgggtgggtcctcaatgattgtttgtggaggtccccttgagggttcagctgactgctgatggtgactgagaggaaattgcccaaggctggggacaccatctgaggggattagaggaaacagcctctcacacagtcctgggaagagtgcctgttgctacgagccagactggaaagcctcataattcacagagcatcggtcagattcttcagaagggtcttgcctgagtagtgggaaataattagccctaaatgaaatgcagccctgagtctgtctaacactcttaaaagcaatgatttaggagcacagtttggcgttcagaccccagttcaaatcccagctctgcctgctgtattacctgctgtgtgacttacagcaaatcagtcctctctaagcctcagtttcttcacctctcaaatgggcatgc

SEQ ID NO: 391226 - DNA, 515 bp, Homo sapiens
caaatcataataagacggcgagttagagaccatgctgacatccacatgctggctgacctcgtggggacatacaccacacacagtgaacgcacattcgcgtgttgcatttgcctgagagacgaacatcccagactccactctgccaaacccttccacctgtccctggggctcaaagaacagcagaaaaccgcacttcccatttcctagggcgtcctggctgcaactcccaactcaggcacaaagaccccttcatgaagcctggaggcccaggctcaaggagcaggaagcacatgctgacaggggacagagagcgggaaaacactcctcagagcttccaggcacagctgcccttgttcccagaagcactgccttctgagtaagagcttctggcagggagccggcagtagccgcccttgccaaggtttctggaaactggcaggcccccacctcctggaaccacagggggcagctggactgctgcccttcatgactggctcgagcgctgcctcccagca

SEQ ID NO: 391227 - DNA, 358 bp, Homo sapiens
aacctgtatgttacttctgaaagccagacagtgacgctaagaataacaaatagattcagatttgtttttcagaaacttgagctatttcggccaggtgcactgtctcacacctgtaatctcagcactttgggagagcgaggtgggcggatcacctgaggtcaggagttcgagaccagcctggccaacgtggtgaaaccctgtctctactaaaagtacaaaaattagctgggcgtggtggcaggcacctgtgatcccggctacttgggaggctgaggcaggagaatcgcttaaacctggaaggcagaggttgcaatgagtcgagattgtgccactgcactccaacttgggtgacagtgag

SEQ ID NO: 391228 - DNA, 734 bp, Homo sapiens
cagggttcaaaatcatacaggagtgatatgttgttggtttgttttttagttctattgcacagcatcgttaatgtagttaacaatggagtattatacatctcaaaatggctaagaaaatgagtatctaatgttctcaccacagaagtatgttaagtatttgaagtgatggatgttaactagcttgatttaatttttccacattgtattcataaatcataacatcactttgtactccaaaaatttatacaattataaattatcaatttacaattttaaaaaatactagaaaatgtttgaaaggcatcaaacttagctatatgatttaatttagatgctagctaagcaataccaagtaaaaatctttactcattttaattcaagatgtattgaatacttactaagtgcaaggaagtatgcagaatgctcatttatttgatactttgttggaaagttaactatattgaatttatctcactcgttttcttttgtcttttaaaggtgagaattctaactcttttagaaactaataacagtttcaattaagttcttgaaaccagattttcagaaaagtttataaacaactatttcagtgtatgacatagcctttcagtataatttggagagcatgatattgttacctgaattacttctctttctactactagtagataataatcttctactagtattaaaacacagaaatgttcttagagagggaaacataagtaactggt

SEQ ID NO: 391229 - DNA, 468 bp, Homo sapiens
aggaattgggagagatgtgttaaaagataaaaaattacagctagataggactaagttctatatttctgtggtctataccagtgtaggatgactatagctaacaataacatacaatttcaaatagctagaggaggtactgcatgttcccaacatcaagaaatgataaatgtttgagatgacggatatgttaattgccctgatcactatacattgtatgtactgaaacaccactgtgtaccccatgaatatgtacaattatgtcaatttaaaaaacaattttttaagaaaagcaacaatcagattgagagaccaactgatgccccaccaccaccaccaaaaaaaaaaaaagtacatgatttcttcatcatgtcactgaattaatttttgccactcaagagaaatgcctgcactgcagtttttccacactcttcctggggatctctctcctcattgcaaaagagatgtgcc

SEQ ID NO: 391230 - DNA, 335 bp, Homo sapiens
tgacacattgtgactttctaaaaacctttttggtgcccaaccaagttccactagtgacccagaaggcccgctgagattgtgctgattctgaggtcacggtggacctggcttctcagtcctttattttggcctttggaaaggggcgcacgatagctctttattaaagacacttgtaaggagcctaggcaaatcattcaaacttctgggattcagtttatctaccttataaaaattgcgtatttatgcctgtgtcttttactcacattaagattaagaacaaatggcctctaaataatatattataaaattggcaataaagttaatgatctagttga

SEQ ID NO: 391231 - DNA, 248 bp, Homo sapiens
ccacttcaatgtcctacttcaatttcccctttctaaaagaacctggtagtaacagtgaaaagataatcatcatgacattataaaatactgctttaagaaatctgaacactgatcatttatccttctaaactgcctcaagtatgaggtaagcctgaaacaaattcaaagcctcttatttctctacaaccaagagaccttaaaaacaacaggatctatatgttccagagctaacgaatgtataaatggaa

SEQ ID NO: 391232 - DNA, 720 bp, Homo sapiens
atgcgcggcgccgcggggccttagcggacggaggggagcgcgggggtcaccgggccgggccggcagccctagagctcggcctggcggggaccctgggccagccccgcgcctccgtggcccgggcgtctcgtgcgtgtccgcgaactcgcgtgcgcgcgtcacctcggaccgcagcatggctcggagggcggccctactcgcgccgccctagtgctgcgaagggcctcggagcccaaacccggaaccgccatctgggactgggaagacgacatggccagaagccgactggacagccggcaccaccccatgattcaaggatggccatagcccagtgcaggagcagatttgcttccagtttgcccttcctcctagagttttgctcttgtcgcccaggctacaggacaacagtggcgttatctccgctcactgcaacctccgcctcccaagttcaagcaattctcctgcctcagcctcccaccaccacacctggctaattttcggatttttagtagagatggggtttcaccatgttggccaggctggtctcaaactcctgcctcaaactcccaaagtgctgggattacaggtgtgagccaccacgcccagctgtttaatctctttttaataaaatatttcatggttatcattggattctcacagcaccatttgaggtatacgagcgaggttagtccaaatttaacacacgtgctcaactcgtgg

SEQ ID NO: 391233 - DNA, 1242 bp, Homo sapiens
  misc_feature (1242)..(1242): n is a, c, g, or t
atgtaatggcagttatattttgcagttcccacattaaagaagacctgagaatgtatccccaaaagcgtgagcttaaaataacaagacaaagccaaaaaaaaatattataagaagacatataaagaactcaagagaagacaattgaaaagaactaggacaatagaaaacaaaacccaaaaaacaaaaaagagaagcaacacagaaaacaaaacaaaccaaaacaaaaaaaaataaatataaataaaaccaaccataaacaaacaaaaataatgccacatacaaacatacagtgttataaatttatcctaaatattaaacaggtataagccccccatagaataacatactacccaatgatacgaatatgtgaaactgaaaactaaaggactaatagcttaataggcatcttcaggtatagaatatatatcaaattatatattgaactggatatttttcttaatagcaagaacaaatctctattcattaagttcatggtattatactagggctataggaaggtaataggagagaaccaatattgaggcaagaaaaagataaagatatttcaagatatgacacttgaagcgaaaagatatgttatgcccagttaaaatgagaactgataaccaagaactatagggaagtaaaaacacctgcttgaaaatataaaacggaacgattataaaagaaatagaaaacaacttataaagagcttaaaaacgaacagaggcgcagtttacctaagggataaaattgtaatcagtgaacattatggtgaagaacaaaaaccaaaagcgatatattacccaaaagaactagataacctaaaagaaattaccgtatataaaaatttaacccaaaatttttttggaaaacttcgcgcggaaaagcggcttctcttctaacagtttccttgaaaacacacgaattttttttggccacccttcttcgtcggccgcgaaagaaaaagggttggctaaaagacccccagacaaggagaagttgtcgcgaggccccgccagagaaatcagaaggagacgccgtagtcgcaaaaagctagtgttccccggaagaaggggaccgcaatgctcgagcacaacatgacggtggagaacccgccgccgcaaaagagacagcccccgggtggacagcacacgcgtgatagacctcatacacaaagatagtgtgcagagggggcgaacagggcgcatgcgagcaaaatacggtgggcctgaagagacn

SEQ ID NO: 391234 - DNA, 480 bp, Homo sapiens
gacccacgcgtcagccggacgcgtgggtcgaccacgcgtccggaacaggatcctatcaggcgaccaagaaggaagatgtactttcagttaggtgtcagagaatgtctctgaggaactgacatcattggaggcctaaagtgtgaatgagagggccatccatgcagagtatgtggtgtgtgcaagtgtgtagaacttatctgaaagagcacactgtataaatataggccctgtggtgtgaaagtattgacctatttgggcagctatgataaggccagtgtagctggcatggaataagcaacagagacagaaacatgcacagtgaaattggaaagataggcaccaaatcatgccggagcttataaagccaggatgaaaaatttagattttgattttataagctcagtggaaatgatctgcatttataaaatattttttggctcccatataaatgattggaggaggcagaaggagagtcaggaa

SEQ ID NO: 391235 - DNA, 529 bp, Homo sapiens
gcactggctgtatgatcctagagctcaaagcagcagcctgaatatttcagcatgtaggtgatataaagctgtggaccaggacgagctcctctggggaaattggtataattgagaacatctcagggtccaggtacctttgactctgcctaccctaacacacctggaagctgttctctcagtaatcaagttatttgaggccagtggagagaaaagtgtgactattattctcacctatcaccagttctaccctttgggcagacgatgcacttggctccctgattgcccttctcactgataaagttacataaatgtcaccttggataaaaaagaatgttgcctcagctgcataattcttctacaaggagaattcttctacctacatagcctcaatttttacccctccttgttgtgttacctatacagaaataattttctgtcttcttctcttacccctattttctttgctgtatttcttttttcttttcttttccttttttatgttttatgttttagagatgggggtctcact

SEQ ID NO: 391236 - DNA, 372 bp, Homo sapiens
gaaaggggataaatgggagtgacgtccaggcatgttgggcttggtgtgtggcccccaggatcttaggaggagccagctacagaggggtccgaagcatggtgggaggaggagactcaaaaggaacatagccccagtgagttccggagggcaaagtgggacctccagtgacgacgacagcctgggagacccaagttcaagacaaaatcaggatctgctcagagaggagactggcagagagccagaatcaacaggagggaacatgaggccatgcagccgatgggcagcgcagctgggccggggtgacccagggctggacaggctggagactctcactttcacaaaatgctggctggctttccagaaaagaccctg

SEQ ID NO: 391237 - DNA, 366 bp, Homo sapiens
gccctgtggatattgagggatgactgcaacaagcagacttcgctttagaccgagttggccagagccaggtcacgtagcaccccaggtgtggttgaggggtgactaaagggagtggacttgggggtggctgtgagatgatccaatgaggaccatcagccacattacctgggtaatgtcatcattctaaccacatccattatcgatagtgtagatatggaattttaggcaattttcactcttccagtggtagccctgttactccttgcagtggatgagtagatgttcttgataagtctgccacctccatccagataaatgccataagaggaatatttatagtcatcgtacacagtatatgtattgact

SEQ ID NO: 391238 - DNA, 146 bp, Homo sapiens
ttcatggttgggggagcagcgggagacggggagggtgctaggaggagagggcgggaaaagagggctctctcctcttccaatcctctgatcttcctgctgttgggaggtgcagattcattgtgccccagcccacgtccccccacgac

SEQ ID NO: 391239 - DNA, 428 bp, Homo sapiens
  misc_feature (385)..(386): n is a, c, g, or t
  misc_feature (412)..(412): n is a, c, g, or t
  misc_feature (420)..(420): n is a, c, g, or t
gctccgccctctctgcctcccaaagcgctgcaatacaggcatgagccacctcacccggctggcccaacccatgagtttttaaaagtcccacagatggtttagaatgtttctaatttatacctactgccccacccctcacactcactcctgatttgaggacctctgttaatggttagatgaattggagaaatctgtgcttgaaatcaatccgctccatactagcttggttacttagacaacattttaaaacaatgtgcaccttccacttctcatcacaaagcaagggagaaattattcagcaaacatttattgagctgagcagtgaacagtagacaagatccctgacctctcagagcagtcaacagataccagacagtagtagaanngccgtggagacagaaataaagcaagngataaggngatggtga

SEQ ID NO: 391240 - DNA, 409 bp, Homo sapiens
aagatttctttacaaagagatgtgaatataaagattaattcattgtttatgtccacaatgtggacattaaaatccctggatcaccatcaaacctaactttcgaagcattcatttattgtacacatattaattgtttgaaatttaaaatatacagtatttcccaaccaaattattttgagagtaaaatgtcaaaattgaaccaaagtcctatttagaaagtattcaagcttttaatgccaaaagccatttttaaagaagttcttaccaaagtaagttcaactgccagtttttttgttttattttgttttgtttcttgagacagagtctcgctctgtctcccaggctggagtgcagtggcatcatctcggctcactgcaacctctgcctcccgggttcaagcaattctctg

SEQ ID NO: 391241 - DNA, 459 bp, Homo sapiens
ctcttcaccccaaatttttaaacaaagcttctcctccttaaccagctgcaaatcagaaaacctttgaatccacctataacctataaggccctgcttgcagataccgcccttctaggccaagccgacatgtaacctctgtgtccttatgcacgactctgcctttcagttctgctttcctgagatctacccccgctttacaagccttgcctgtagccagtgggggaggccaggatttatacatgagcctcctggcccaccttgcttggcgccctgcaaatacacacgtcctttctatgacaaaacctcggcatgggtgtctgggtttactgcaccaggcatgtggaccccagttcatctgtaacaagcacagatgaaaccgtcaggtcaagggactgacccctccttgggagccatgagccaaacgttctcagagcctgggaaggacagagactcatccga

SEQ ID NO: 391242 - DNA, 560 bp, Homo sapiens
aaacaccctcttcctcactggtcagtgataccctgtgctcacagctctactccccctcggaatctcctgtctgaagcccctgtaggactctgggatcctccgaatcggccctctccagctccaagcacactgggatccttgccgcaggaggttgctgttggcttctgcccatgctgtgggtcaggatctgcagccaacaggcgtgggagcttaggaaggcacctggtggtttctcggtaggaaaatagtgtggagtgtgtgcaatcatgtttgaggaagcgtcatgagagggtcactgtctctgtggtagtgtccttagggaaccgtctttgcctggatcctggggtcaggtttggcatgaactctgaacttcctccctccgcaggatcttcagtagaaaggtcctgtcctgaggaaatgctcagaggcacttctcttgctgaggaagcctgcctggatgtgtgtttttgtcctcatggagatgcacatgacaaattgtgtgcaatgcctcagcacagcccaacaggttttttctgtttacacttaactagcctacgaca

SEQ ID NO: 391243 - DNA, 363 bp, Homo sapiens
ttatttatttatttatttattttcgagacagagtctcgctctgttgccccaggctcgagtgcagtggctcagtttcggctcactgcaacctccacctcccaggttcaagcgatttctccctgcctcagcctctggagtagctgggattacaggtgcccgccaccacgcccagctaacttacgcattattagtagagatggggtttgaccacgttggccagggttgtcttgagctcctgatctcaggtcatctgcccacctcagcctcctaaagtgttgagagtacaggcgtgagccatggcacccagccaatttcatattttgtcaggccacagttttaaaggtctcgttccatttaatcatg

SEQ ID NO: 391244 - DNA, 384 bp, Homo sapiens
gagtctggattaatgaagacctcttgctcttaggagggtctttcctctttattgttttagaattctggacttgacccagacttaaattcccatctgtgatgcattttgcaataagtgggtttgatgccagcactttgaaagatatccctcataaaacaaaaggacaagaatcaccagctcccacacaaagtaaaaaacgtgaacctaattttagcagtgttaataaggagcaactatccacaagtcactgcatcaataatgcttgtgttataacatcctctcctccctaaggcacaggagcaagtgacacatacttgtctgggaaccagtttcattaatacttttattgtatccgtccaaagatgagtagcaatatctgttacc

SEQ ID NO: 391245 - DNA, 470 bp, Homo sapiens
cctgagtttcctcctccctcataagctgctttctcaattttttcttacaagttatatctcctttgaccactaaatactggcattcctcagggcttagtcctgtatcctcttcccaggtgatctcattcattttcatggctttaagcaaatctacatgccaacgaattttaagtatctgtctatagaccaaatctctcctctaatttccacgtgtctacattccacatatctacattcagttgccaacttaaaatcccctatggaggccaggtgcggtggctcacacctgtcatcccagcactttgggaggccaaggcaggcaaatcacttgaggtcaggagtttgagattagcgaggccaacatggtgaaaccccacctctattaaaaatacaaaattagccaggcgtggtggcaggcacctgtaatcccagctactcaagaggcagaggcagaagaattgcttgaacct

SEQ ID NO: 391246 - DNA, 489 bp, Homo sapiens
tgtgcatgagtggggagggcggcatgcataccatgaacgtgccactcgagccagcctggggacaggacacatgcttgcccttgagctcacctctgtggatagacagtcccacaggaatgcctgtccccacgggttgccggtgctgtggtggaggaccgtgaggcctctgctaaaaggcctgggggctcggaaagggctccatggaacaggggacccatcctgaggcccttggggacagagcagtgcagaatcagtgatctggaggaagagcagcagccctctctctgcagaggtacagcagaggctggcaggacccagcatgctaggggaggccctgtggcgtggcgggcggtgggtgaccggggtgggcgagcgcggtggctgagctcagaccctggagccagggcgcctctgggggtccccgttctgcctgcactcactgcagctacctaatggggccatcatagcgcctgcctggggaggctgcga

SEQ ID NO: 391247 - DNA, 684 bp, Homo sapiens
accaaaaaaatggattttgggggcaaaaatacaaatattaaagattgcaatcttaacagtattattaagtatcacctgcttattgtaaaatgcgtattgtgttcattattgcttgaaatttaggagcccccaaaaataacaagtccctgtctgtggtggtttgccttaaacacttacatcaaacttagcattaacttctggtgcacagtagtgtgctatgtaattttctttgataagttctgttagtatgttgccaaagtatgcagtattgacttctagagtgtaaatacttttacttggaaaagcctaatgtatcttttaacaatattaaggatagcttgaacgttttctcttattgattgtctacattaaacatttaaggtgctttggttttagctgctgtcattaaaatcaaccaaagtgtgttaggaatataatgttccttcttaaattgaggattggctgtaaatgctaagtgcctgtggcgtggatggtgtccctaaccatgaagaaaatgtgcacagtcacttctgtgttcctgtgggccaaatcacctgtttcttctatttggaagatcagttcgatgacctaaaaaattaagttattgtctgtgtacccaattgaccttccacttaaagccaaagtattcagctaaaaatacctttatagtttactggtaggttg

SEQ ID NO: 391248 - DNA, 516 bp, Homo sapiens
gtccaacatctaaaagacattattttatatgttttgtccaatttgctagttgtttaaggtgggagtatcaatcatgttcctcttactccatattttcccaaagtggaagtcaacataccatgtattgggttgtataagagaatctccttattcttaggatattcatgatgaaatgtttgggttaaagtattattatgtccctaaattactttctaatatttcagaaaaaagaaagtaaatattagaaagtattaataattattgaatgttgaaggaatgtatatatgtccatggtgctattttctcagcttttctgtatgtttgaaatttttcaagataaaaagttttaaaaaaaagactagggataaataaaatgttatagctaaatatggagagttgaattatgagtatataatttattgtttttcctgttttaaattctaaaaatgaattctaatttaaaatataatatttataatagaatctaaaactataagggatctaaaaataaaatta

SEQ ID NO: 391249 - DNA, 254 bp, Homo sapiens
cagacagagtttttaaatggtttggatgtatcttcaggacaaattaccatatttgaagattttcctaaataaaaaaaaccaaatagatgtaaaaatctatgacattctttaacttttattcttgaaattatgttttcagatgaaatatctgtaaaatatgtaaatataatatttaaaacctgacctaggtattatataactttgagataaatgatgaaataaatgagaacttaaatgttctaaactctttaagg

SEQ ID NO: 391250 - DNA, 143 bp, Homo sapiens
agtaaacatcagacagggcacgatcggtgcatcacctttgaacacatagagtgtgcttgtctggcacacggggcagggctgactgaaatgatgactaggaggatgagaaaaattcctgagggaggctgtctgcatcatcgggg

SEQ ID NO: 391251 - DNA, 470 bp, Homo sapiens
aaagtcttttaccaatatgtctgtgtagacattctggatttcttagatatcttttctgtggttgtggttgtgacctctctggatttttgcctgtgaatttccaattagagaagttttgctggtttattttctcatagtttataatcttttgatccctggtatctgtaggttatccctggtgtctgtagattatctggagctgccataagctatccaactcttttgtttgtttgttttgagacagagtcttgctctgttgcccaggctggagtgcagtggcacgatctcagctcactgcaacctctgcctccctagttcaagcgattctcctgcctcagcctcccaagtagctggaactacaggtgcccgccaccatgcccagctaattttttgtatttttaggagagacggggtttcaccatgttagccaggatggtctcgatctcctgaccttgtgatccacctatctt

SEQ ID NO: 391252 - DNA, 374 bp, Homo sapiens
ccagttctgacacatactagattacttgggttcaaatcccagttctgacactagattacttaactagcaagttgcttaacttctctgtgtctcagtatcctctttcataacaataaggctattgtggagattaaatcatatcagttccttcaaagaacttagcacatatgagggtgttaaatgttcataagtgctcagcacatggtaagtgctccataaatgttagcttttatgagtgttggctgtttgttaggactcacattctgtacatggaaacatttatcaggactctgattttgtaagtggaaaaattttcagattttctcaagccttgcacgctgtcataaaatttcatgaggataaagtcatcagtt

SEQ ID NO: 391253 - DNA, 229 bp, Homo sapiens
tatgaagaaaagagtgtgttgtgaacgaagtcagaatttcctgtgttccctttgccgctcctggagttcactggttctccttccagggaacccagccttagatgattaaaaaaattgaggagggcctgaagaagcagggcagcagtgctctggaggtggcagaatcacagctggtgttaacgagttccagtagttaatcttccatccacctctgtccttatccacctgg

SEQ ID NO: 391254 - DNA, 326 bp, Homo sapiens
aattactagattcctataatgtattagcacttttctttggttggataacaagggaagcacagatttgaggcagagatctctcagaggcttattgggagtgctcttagaactatcattgaagccatgacagatgcagggttggggagagtgagaaggcgaactccagtgcagtcgcaacaaaagcccagcaaattcctcagggcgggagctctggagttggcagagaccttcagagatgtccctgaaatgaagcaaagatgaagaagccaatcctttgtactctggcattcattgggattcactgggggctgcctctggggagaaga

SEQ ID NO: 391255 - DNA, 777 bp, Homo sapiens
ctcgtccaagaaagcaagaccctgtctcaaaagaaaagaaaagaaaagaaaagaaaagaaaagaaaagaaaagaaaactgaaatatgagaaggaatcccaggtgacaaacgggggtaaggaaagtatgtttgaagattttgcagtgggaaggggctttgtgagtccagaaacaaggaagcccagtgcacctgctgtgtagcagcaaaggggaaagtagcacagggaagaagcagcaggagccagaccttccagggccttaagcaccacgaataataaagcatgtggattttatcttatgaaattagaagtcattaaagggtgaggcataaaataaaaattcttgccagacacagtggtgcatgcttgtagttccagctactgaggaggctgaggcaggaggattgcttaagttcaggagtgcaaggctgtggtgtgctatgattgcacctgtgaagagccacttcagcctgggaaatatcatgagactccatctctaaaaaaaaaaaaaaaaaaaattaaaagtctgaatattttaagtactgaggagggccaggaagatggatggcattaatcatagtttgtcatgtggatcatgccctagagcagtaaaagaaaactagtgggaaaaaagagaaagtcctgtgaaaattatgaagttttcccacaaagtattgtaccacaataaatatcttgagaagaagaaaaaaagtctaagtaaacttggtggactgataggaaagcagaaaatagctaaaagcaaaacattaaaaaaaaaa

SEQ ID NO: 391256 - DNA, 699 bp, Homo sapiens
  misc_feature (672)..(672): n is a, c, g, or t
caggttgaggatgtgtattggaatatcttaattccatcgtgcacttaacttcatgttacttagcttgtaaaaccaaaagaactttgttctttggattacccacccaaacaattaggtgaacactggaataaacatgtattttccagaaaagtttaccttttcattttttatgcatttttgcaaataagaaaacaactatatttctgaactttttgtaatgtttaatttttgggggtacacagtagatgtatatatttatggggtacatgaaatgctttgatacaggcatgcaatacataattatcacatggaaaaatggagtatccatcccttcaagcatttgtcttctgtgtgacaatccagttacactttcagttatttttaaatgtccaattaaattattattgactgtagttaccctgtgtgctatcaaatatcgggtctaactcattttttctgtacccattaaccatctccacttccctaccactacccttcccacctccgtactggcccgaagaagctgacagggatcaagcatgaatggcaagcaaactgctacgaggaggtcaaggaccgctgcaccctggcagagaagctggggggccagtgcgtcatctccctggagggcaagctttgtgagcccttttggccctgtctgggcattggggnccaatcgtatggccggtacgagtcgag

SEQ ID NO: 391257 - DNA, 491 bp, Homo sapiens
caatacccatgggttattttggcagtttctgaatgcataaatggaatagacatattcagtttctggcagaactttcacagtgatttctaacctttagagtgccaactgaaaaatcacatgatttataaatttagaaaggagactttcttttctttagagatagtctcagttgcccaggctggaatgcagttgtgtgctcacagctcactgcagcctcgacttactgggctcaggtgattctcccacctcagcctcccaagtagctgggaccataggtgtgcaccaccacacctggctaatttttgtagtttttgtagagacagggttttgccatgttgcccaggctggtctccaactcctgggctcaagtgatccgcctgccttagcctcccatcctgaccgtgatattatactacaggattttaccattgggggaagctgggcaaagtatataagtgatctctctatattacttcttacaactacatgtg

SEQ ID NO: 391258 - DNA, 314 bp, Homo sapiens
tggcggtattattgggagaaatcacttaataccatcttatattaaatggaagaaaggttttaaataggattttcaaagatctagaatacaaacacattttcaccatgggtttttttttggactaggaaataaattcatttgtgtgctaccaaatatcataaacatctaggtctactaaccactaataactagaaaactggctttaaagttgttgaaatgaagatgattataaacacttaaggtattgatttgtacaaaccttcctgtttctgagtgcctttaagaaaattaaagggattttggaagtgtgcaaa

SEQ ID NO: 391259 - DNA, 551 bp, Homo sapiens
ctgcaacctccgcctcctgggttcaagcgattctcctgcttcagcctcccatgtacctgggattacagacgcccgccaccgcgcccgcctaatttttgtatttttagtagagacaaggtttcaccatgttggccaggctggtctcgaactcctgacctcaggtgatccgcccacctcggcctcccaaagtgctgggattataggcgtgagccaccgagcctggccgacctcctcagcttctaaaggacacagtaccttggaggaatgtgcacggagggatggagtcctacactcctgggatgccgaaatgctgagagtcaagagactgggatttggggggacaaggcttccagggttccgcctgagcaagggagtttttgacttcttagacaggaggttctttcacttcctttggagtgggtctctgacctgggaatgtggggtctgggtttgatggtccggagaaggaataaatagccctaggatgggatgggtaaaggccaaggtttcttgggatgggggtttctgaatggagcaggggcctcctgaga

SEQ ID NO: 391260 - DNA, 190 bp, Homo sapiens
ggcctaaaaattttgattattgtattattttattttagaagttctgttaggttattttaaaatttgttgtcatgtgatataattttctatactttggcaatgtttctaggttatttatttatttaaacgcagtaaactttttttttttttagacagagtttcgctcttgttgcccaggctggagtgagat

SEQ ID NO: 391261 - DNA, 460 bp, Homo sapiens
cacctgtattcccagctacttgggaagctgaggcaagagtatcacttgaacctaataggcacagggtgcagtgagacataatcgcaccactgctatccacccagatcaacagagcaagaacctgtcttcaaaaaaaaaaaagatcagctgggcatgatggcacgcacctatctatggtacatatcccaactactcaggaggctgaggggggatgaacacttccgcctgggaggcggagggtgcaatgaaccaagatcatgccactgcactccagcctgggcaactagagtgaaactctgtcttaaaattaaattaaataaaataatttatccaggtttggttggcggcaatgcacctgtggtcccagctacttgggaggctgaagtgggaagatccctttatcctggaaggttgaggctgcagtgagccacgatcatgccactgaactccagtctgggca

SEQ ID NO: 391262 - DNA, 568 bp, Homo sapiens
agcggggaggatttactcgtgtctgagatacatgtcttggtgtaaaaaaaataataattcaaaaaagcaaatattagctatcaaaaaatcagtagattatgtctgtgttttagaatatggtttccaatctaatttttttctttctttttcttttttggagatggagtctgtctctgtcaccaggctggagtgcagtggcatgatcttggctcactgcagcctctacctcacaggctcaagcgatcctcccacctcagcctcctgagtagctgggatcacaggtgcacaccaccaagcctggctaatttttatattttttgtagagatggggtttcacgatgttgcccaggctagtctccaactcctaaattcaagtgatcctcttgccttggccttccatagatatgagccaccagacctggccagttggagggatttataatcacctgaaattttctttactcctctggttactggaaattgcagatttaagtaccttttagaaaactggtaggaacctatgagagtaaatgctaagctgaagcagtgactctttaaaaattaagcc

SEQ ID NO: 391263 - DNA, 947 bp, Homo sapiens
  misc_feature (15)..(15): n is a, c, g, or t
  misc_feature (34)..(34): n is a, c, g, or t
ccccttgggaggtgnatccacatgtgcaacaaancaaaagcctcatgcttctgcagttgacattaatgtactcacacttatgaaagtttgccaatccctgatctctgtttaatacattctcgcaaatctctataaaagtcagtagtttgttcttctagaagttagtgggtctacacatgaaattcgttgtaagaaatatcaaagaatgtccagatcctccaaaaagaagagaattaattattgaatttgatttaaaataagcaggtcattgggtgggatttagaaatctgattctaataatatttgacctacagctctattaggaaaaataaaaaggcatgtaactatcttgaaattcaaaccatatccacagttattatgttaaaggagtggttttcaacctagagtggtggcaacttctttctcaaattaaaacaagataaaaggtaagctattctccctcaagaggatggaggatgggaaaaatgtttaaaaaaaaaaaaaaaaacactccaactatggagcctttctcccttcataaagcagctcggcagtcactctgtgcaacctaaggctttggagatcacagatggaaagccacctgtttgaggtaacagaaggaataaggtcactagttcgtagatgcaatataatgacacaggtatactaagctctcataaatggttatatgagaaatataaattaaggctcatgtaaatatacaaagtagctgattacaaaaaaaaattatgaatatctttgtaaagtatcatttccaacatatttcctatgtaaaactttttttaaaaaattaggtttgctgaaattgaaagatacacatacttatctctgaactctttctaactaatggtcagtgaagaaaagtgcaaaatcctttagtttattagctaatgcttggaaatgtaactgttcattaatccttaatt

SEQ ID NO: 391264 - DNA, 377 bp, Homo sapiens
cagactttctcagacttatttgaccatgcaacttttatagcttctgtttagtgggtctacacatgaaattcgttgtaagaaatatcaaagaatgtccagatcctccaaaaagaagagaattaattattgaatttgatttaaaataagcaggtcattgggtgggatttagaaatctgattctaataatatttgacctacagctctattaggaaaaataaaaaggcatgtaactatcttgaaattcaaaccatatccacagttattatgttaaaggagtggttttcaacctagagtggtggcaacttctttctcaaattaaaacaagataaaaggtaagctattctccctcaagaggatggaggatgggaaaaatgttt

SEQ ID NO: 391265 - DNA, 342 bp, Homo sapiens
tgagacagggtcttgctgtgtcacccaggctggagtaaagtgacacaagcaagtctcactgcagccttgacctcccgggctaaagcaatcctcccacctgtagctgagactacaggcatgcaccaccacgcccagctaattgtgtgtgtgtgtgtatatacacagtcagggtctcactatgttgttcaaactcctgtgctcaagtaatgcacccacctcagcttccaaagtgctgggattacagacatgagccaccatgcctagcctccacaacttttaaacagcctgacatgagcacatttcctaaccatgactacacagacacaaatgcatttcctaaag

SEQ ID NO: 391266 - DNA, 367 bp, Homo sapiens
gaggttgcagtgagctgagatcacgccactacactccagcatgggcaacagagtgagactctgtctcaataaataaataaataaataaaatgaggctgagcattttattatcttgtagagcttttggctttggattttggcatctttgggatccgtggtagcctggtgtttgctggttacccattgactcttttgcacacatacaggcagggtagtaatacctcttccctggtgttcacaggtcaacacccaagcagttttgggtgtaggccatggaaggtggtgtcaaaagacaaaatcacagcaaatttgatttaaaactcgaattggcttttatttacaattctaggatcatgcagcacctcat

SEQ ID NO: 391267 - DNA, 243 bp, Homo sapiens
aaggaaagaaagaaaggaaggaagaaaggaagggaaaataaagaactttggaattgtccctgacccagaacttgaatacggtcaaaatttatactgtctatctcattcaaagaggtaacaggtatgcaagatttctctttagttgttaccaatttcagtatgtattaatagtgtttttttgtctttccacatatttttatagttggacaatccttaatcttatccttccttatttttttcttt

SEQ ID NO: 391268 - DNA, 306 bp, Homo sapiens
agtagagacggggtttcaccgtgttagccaggatggtctcgatctcctgacctcgtgatccgcccgccttggcctcccaaagtgctgggattacagatgtgagccaccgtgcccagcccagagttcttttatcctctagaaaattcttcattccatagagctttttcatattattagcttaattatgcataatgttttataattaaaaatttctctttattttgttctatcccctgtttcctgtaaactgctgtttgtggtttactcgttattagatttgtcaaaggtttatctagcttactattg

SEQ ID NO: 391269 - DNA, 245 bp, Homo sapiens
ttaactggcccagtgtgtcgagtaaggttagataaggggaaaagtgaactcagcatttcccaggcagaggcaaggacctaaggacaagttggggatgtgggggtggaaaatcacatttgagaaatggaaataattcagacaggtccaaggtatttgagaagagaaggaaaagggggcttgctatgctctgaatgcctgtgtcccccaagcttatatgtgtgaccctaacaaaaaacccaccgagt

SEQ ID NO: 391270 - DNA, 150 bp, Homo sapiens
ggctctgctctgaaggaatctgctgctggcagaagtggggccagtttctttcctgaattgtagacacctatggactcatggtgacaaaccacagaggcttcaaatgaaaagtggggcccctgagagacaggacagtcaggaaaggaagga

SEQ ID NO: 391271 - DNA, 353 bp, Homo sapiens
gggtcaggagcccagagaatagttaaacacattgagataagctttgtatattttcctttggtgcatttcccgattctcagtgcatggcataggggctacacagagagcagtagcctagagcagtcattcaaccagggagacaaaattggagtttggggttaccaaagagccaggggttgcagagccgagatcctgaggaatatcaggggtgaatccaactttttttttttttttttgagacaggatctcactgtgtcgcccagactggagtgcagtgcggtgatcttagctcactgcaacctccacctcctgggttcaagcaattctcctgcctcagcctcccaagtagctgg

SEQ ID NO: 391272 - DNA, 305 bp, Homo sapiens
ctacaccttgccttcggaaaacctatatgatacagtgattagcttgggcttttctaacttcttcaacaacattgagaatgattcctgaaaaactacagatcaaaaatggatacatgatttattcctcttttccttgaatatgaaaaagctgaaattgacttcaaaaggattctctgggagttataactatgctctagcaagaggttccaataaatcaaagatggctatctgtgttgaacaaaaatccaggaagaaaactcatgacccactccagagcaatctgagcaactttctcaatctttaga

SEQ ID NO: 391273 - DNA, 370 bp, Homo sapiens
agtcccttccacatcatccaaaatctgtcccatcagcacctccccccactcctgcccaagccgtgtcccctctggcctggatggctgccccagcctcctccttcgcctccttcctcttattccctcccgttcacctcactctgcccccaccatcacacacctcattctctaactgcagcagcaggagtgcgtctaactttacaatgcaaacttactgctgcccagctgagaagccctcaacagcttcccatcacacttagagcaaaccccgcaaccctcccctggccctcaaggctccctgtgagctggtccctgcaggcctctccaatcccactctccctgccccttgcagtaagttactcccttcctg

SEQ ID NO: 391274 - DNA, 326 bp, Homo sapiens
ccgaaaatgtctctagacattgccaaatgtccccttggggtcaaaactgcaactggttcggaaccactggcctactgggtgaggaggggttggggaatcggtggtagtgaggactgcaaagcacattcctgcctgtcatcctcccagccaccctggggctggatgggattagagaggctgcttgcagcattgcttgctgaaacttgctgagaagtctcttaactgagctggccattgatgagatgtctcaggggaatccattccagggcccctccactgggtcggggactgttggcattttgttctgacacctccagttcttaaat

SEQ ID NO: 391275 - DNA, 439 bp, Homo sapiens
aggcatgtggatggactatttgagtagctaggaagtgtgaagaggaccaccagaaagcatctaacttgaaagaaacaccaaacaaccagctagacagaatgatttagccaatttgatgtcaaccagatgccatcagccaccccagaactgacacaacgggcatgtgaaggagcaactgtggtggcagggatggggacaaacacatggaccgtcactcacaagggctgatgtagctaccaccactgctgaatgttcagcctgccagcaatgcatcagtgctgatcctcggaaatggcagtagctctcaaagtaaataagtagccgcttggtaataagttgactacaatgggtcccttccatcctagaaatggcagaaatttattttgactagaatggacacatggtttaccttttctgcctgcagggcctcagccaacgc

SEQ ID NO: 391276 - DNA, 324 bp, Homo sapiens
actgagtgaacactggcttttcctggctctgatgtgccaggcattgggggcatgagaccagatcaggtgcagttctgggaccctagaatcttggagctgcttgtccagtggggagaagccaatgaacaaacagcagtcaccccactggtcagtgctaggctaaaagtagtgatggcgatgacagcagcgcctaccgagggccagcattgtcctaagcacaactcattttgtctccacagcgaccccatgagggatgtaatagtagtaactggcctgtacagtggctcatgcctgtaatcccaaatctttgggaggccaaggcag

SEQ ID NO: 391277 - DNA, 472 bp, Homo sapiens
gggcacagattcgtcttctccatcatcgtatcctcatgtgacatagtgcccaccacatggcaggcactcactgggtattacttcagcgaatgaaggaagaaatcttattgccaataccactacctggtgtagaactcagcagtttccaaaatgctctcagatacacatatattatcatgtttattctaagcacttaattcatcaactcccacaataggaggggctgagaacacaactcattcctagtctaaagtggtcattttggctgggtgtggtgactcatgcctgtaatcccagcaccttgggagaccgaggcaggtggaggcttgagcccaggagttcaggaccagcctgggcagcatggtgaaaccctctctaccaaaaatacaaaaattagctaggcgtggtggtgcccatctctgtagtcccagctactcaggaggctgacatgggaggactgattgagctggag

SEQ ID NO: 391278 - DNA, 483 bp, Homo sapiens
atgtgactacaaaaggacagcatgagggattcttgtgatggaaatgttctgctcttcactgtatcaacgtcagtatcctggttgtgataatgtactacagttttacaagatattacattgggggaactgggtaaagagtgcatgggatcattctgtattatttcttaaaactacttgtgaatctagaaatatctcagaataaaaagtttaatttaaaaatgtggctaacatccatatggccttaacacagaatggattcttaagtacagattatttccaccatcacatgttgatcacaagacaggcagtcagggtgctaccgcatatgcttcaggcttgtcatagtgaatacagagagagccaagagttacactgcaacaggatgccacatgttctctctccaaaaggaagagaacaagatgaaataacatcaatgctaattttataatgagctacatctaatacttccctggacccagagtt

SEQ ID NO: 391279 - DNA, 387 bp, Homo sapiens
tcagtgaagtgtcagataagcaatctacgttaagttcctctggcttcaaggtgcaggaccaattggaagggggtaaaattagaagtagagtgacatctgcaatagttcagatgagagttgagaagagcctacattaaggccatggcaaagatgatagatagaaaaggccagatctgagacatattaggaaataaaaatcaagaggtataagtaacaggatatggggatgggaagaacaaattcaggatgactcctgtgtttcttgcttgtccactgggtggatggtgctattgtcaactgaaatatgggttagggaagaaagagcaggtttgtggggaggggagaaagaaatagaaaatgaattgcatttcagacatgtggagtttg

SEQ ID NO: 391280 - DNA, 560 bp, Homo sapiens
ggcatttactgatatttagtgggtgcaaaccagagtacctatacatgctacactacacagtatagttttaaacaagaaagaaatgttccatgtcctacattaatttgaacatctggctggacatccatctgagcctggaacccaactttgcttaaatgaaatgacagagtaggttttgtaatatatggcatttttgcagagttttagtactcacaaaatattaaatgttagcatccacccctacctctgcttcttgattttactatactgctgtataaaaggttgaaagacttctgatctgattttattgctcctgaattctgactttttcatgctaaataagtgcaagcatataaacccttttttatatcctttagtatagtcatagactgaacatttacttagtaaacagatattatatgtttactttcctatttcccctttttatcctaaatagaccattttttaatatttaatccttgatatttttaaaatctgtgtaagttatattatccagggatttctagatttaaagagaaaattacagaatgcttgttatt

SEQ ID NO: 391281 - DNA, 486 bp, Homo sapiens
acagaatgtaattttgagactatggacagagatattagaggagaaaactgtgattctcctaaatccaagggctggtggtattggatgggttggctgcaccagcgggagtgggaagacccctttgtggaccttggtgctgtacgggagaggtgataagaatagccaccaacctagcacatcctgcaggctagatcctaggctgggtaccgtgcatatgagtcccgcaagaacactatgaggaaggtcttatgagtccagtattgcagaacaacaaattaagtctcagaaatattttacaaatcgcccaaggtcttccagatagtacatgacaagtgaaattacaatgtaggccttccctgtgtcccactctatattagcaggaggtaggtggtccaggtctttgctatgaaccattcagagtctgacagtttagcgtgcatttccccctcaattttgcctttgaaatctcttgtgcatttgaacaga

SEQ ID NO: 391282 - DNA, 355 bp, Homo sapiens
gtagctaagattacaggcatgtgccaccatgtccggctaatttttgtatttttagtagagacagggtctcaccatgttggccaggctggtcttgaactcctaacttcaggtgatccatcagcctcggcctcccaaagtgctgggattacatgcatgagccactgtgcccggcctatttcagccttttattatgtctaattattctggtttataaacaatgacctaattagtaaaacttgagcctgtacatagtgctcattttgctttacattagcttatgtgaagctgggacagaataagacattgagatattttcagatattattctggtgcaataattcaatcatgtagtcta

SEQ ID NO: 391283 - DNA, 391 bp, Homo sapiens
tgacggaatctctcactctgtcgtccaggttggaatgcagtggcatgatcgcagctctctgcaacctccgccgtccgggttcaatcgattctccggcctcagcctcctgagtagctgggactacaggcacacgccaccgtgcctggctaatttttatattttttagtagagacggtgtttcaccatgttggccaggctggtcttgaactcttgacctcaggtgatccaccagcttcagcctcccaaagtgctgggattacaggagtaagccactgcacccgacctcagagtctttatttattccacttaggacaactatttgtatactcactgctgaagtactaatgcattagactaaagagcgctggaggtgctatataacatttaagat

SEQ ID NO: 391284 - DNA, 377 bp, Homo sapiens
aaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcagcatacaaagtcaatgcacaaaaatcagttgcatttctaaacaccaacaatgaataatatgaaaaa

SEQ ID NO: 391285 - DNA, 4449 bp, Homo sapiens
gggagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaagactcgcctcgggccctgggctcgggccagcattcggatagccacggggagtcatcagccgagctggacgagcaggacatcttggctcctcagaccgtgcagtgtccagcccaggccccagcaggcggcagtgaggagaccatcgccaaagccaagcagagtcgcagtgagaagaaggcccgaaaggcaatgtcaaagctgggcttgcggcagattcagggagtcaccaggatcaccatccagaagtccaagaacatcctctttgtcatcgccaagcctgatgtcttcaagagcccagcctcagacacttatgtggtctttggcgaggccaagattgaggacctgtcccagcaagtgcacaaagccgcagctgagaaacaaccacagtgacatcgtcaacgccatcatggaactgaccatgtagccactgaccggaagctggagccatcctacgccttccctcagctctgctactcaataaatcggtgtcccttca

SEQ ID NO: 391286 - DNA, 4522 bp, Homo sapiens
gggagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaagactcgcctcgggccctgggctcgggccagcattcggatagccacggggagtcatcagccgagctggacgagcaggacatcttggctcctcagaccgtgcagtgtccagcccaggccccagcaggcggcagtgaggagaccatcgccaaagccaacctgatgtcttcaagagcccagcctcagacacttatgtggtctttggcgaggccaagattgaggacctgtcccagcaagtgcacaaagccgcagctgagaagtttaaggtgccctcagagccctcagccttggtccctgagtcagcacccaggccccgggtgaggctggagtgcaaggaagaggaagaggaggaggaggaagaggtggacgaggcggggctggaactgcgtgacattgagctggtgatggcgcaggccaatgtgtccagggccaaggccgtgcgggctctgagagacaaccacagtgacatcgtcaacgccatcatggaactgaccatgtagccactgaccggaagctggagccatcctacgccttccctcagctctgctactcaataaatcggtgtcccttca

SEQ ID NO: 391287 - DNA, 4643 bp, Homo sapiens
gggagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaagactcgcctcgggccctgggctcgggccagcattcggatagccacggggagtcatcagccgagctggacgagcaggacatcttggctcctcagaccgtgcagtgtccagcccaggccccagcaggcggcagtgaggagaccatcgccaaagccaagcagagtcgcagtgagaagaaggcccgaaaggcaatgtcaaagctgggcttgcggcagattcagggagtcaccaggatcaccatccagaagtccaagaacatcctctttgtcatcgccaagcctgatgtcttcaagagcccagcctcagacacttatgtggtctttggcgaggccaagattgaggacctgtcccagcaagtgcacaaagccgcagctgagaagtttaaggtgccctcagagccctcagccttggtccctgagtcagcacccaggccccgggtgaggctggagtgcaaggaagaggaagaggaggaggaggaagaggtggacgaggcggggctggaactgcgtgacattgagctggtgatggcgcaggccaatgtgtccagggccaaggccgtgcgggctctgagagacaaccacagtgacatcgtcaacgccatcatggaactgaccatgtagccactgaccggaagctggagccatcctacgccttccctcagctctgctactcaataaatcggtgtcccttca

SEQ ID NO: 391288 - DNA, 4798 bp, Homo sapiens
  misc_feature (4655)..(4655): n is a, c, g, or t
  misc_feature (4664)..(4664): n is a, c, g, or t
  misc_feature (4674)..(4674): n is a, c, g, or t
  misc_feature (4684)..(4684): n is a, c, g, or t
  misc_feature (4688)..(4688): n is a, c, g, or t
  misc_feature (4697)..(4697): n is a, c, g, or t
  misc_feature (4700)..(4700): n is a, c, g, or t
  misc_feature (4703)..(4703): n is a, c, g, or t
  misc_feature (4707)..(4707): n is a, c, g, or t
  misc_feature (4715)..(4715): n is a, c, g, or t
  misc_feature (4725)..(4725): n is a, c, g, or t
  misc_feature (4727)..(4727): n is a, c, g, or t
gggagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaagactcgcctcgggccctgggctcgggccagcattcggatagccacggggagtcatcagccgagctggacgagcaggacatcttggctcctcagaccgtgcagtgtccagcccaggccccagcaggcggcagtgaggagaccatcgccaaagccaagcagagtcgcagtgagaagaaggcccgaaaggcaatgtcaaagctgggcttgcggcagattcagggagtcaccaggatcaccatccagaagtccaagaacatcctctttgtcatcgccaagcctgatgtcttcaagagcccagcctcagacacttatgtggtctttggcgaggccaagattgaggacctgtcccagcaagtgcacaaagccgcagctgagaagtttaaggtgccctcagagccctcagccttggtccctgagtcagcacccaggccccgggtgaggctggagtgcaaggaagaggaagaggaggaggaggaagaggtggacgaggcggggctggaactgcgtgacattgagctggtgatggcgcaggccaatgtgtccagggccaaggccgtgcgggctctgagagacaaccacagtgacatcgtcaacgccatcatggaactgaccatgtagccactgaccggaagctggagccatcctacgccttccctcagctctgctactcaataaatcggtgtcccttcaaaaaaaaaaaanaaaactcgnggggggcccngtacccattngccntatatgagnctnttncatnacttgccntcctttacancntcttaatgggaaaaccctgccttacccacttattcgcctggatacatcccctttaccaacttcgtattcca

SEQ ID NO: 391289 - DNA, 908 bp, Homo sapiens
gtttacacttcagttaggcttcatcggaaaccgaaatggccaagcagaaagatttagaatcttaggctggagaaaggaaagggctctttgtccaccctgggtctgtggagcattggagaagcaagaggcctgcctcagctcggcatcagaatttcctaatgaaatcttccttggaaactgagactgtgatgcaggcgggagcaccgctgctctgatggagccaaggaaggtgatttgtacctgcccagttccagctgagggggcccctccatcccagcacctgacatctcacccctcagcatctcttgctgacttctgagctgattgctttctgccaggctaaagcagctcccctggcctgctgtggggaggctaactcccttttttggaaatctggctgcagcccaggctgtgtgaggtgtggcagaaaatggggtctgcccagcgtgggggacccactcgtggctccccatcagcttccttgactctcaccccaggggtgcctcctgcgttcatcttcccaggctcttggactgggctaggaagctgtccctctccctgcgggcagtgtgtgcccctgctgctgccctgcctcaacacgtgcactttccacccttcccttcctcccaagcttactcaggtgctgactccttccccaggaagtgctccactcactgacagtgccgttggtcaggggctgccttgaggttggtgactgcccccaggaggcccaagggtggacatctgggtctccaagaacccctggacctgaactatgacattttgtgcatgtgaggctgagtccatggaaatggctttcagcagattctcaaagggagcccgacctcaaaaaggttgaggagccctggtgcagactgtgctggttgtcaatgtgcagagtaactgtg

SEQ ID NO: 391290 - DNA, 367 bp, Homo sapiens
gacagctggggtgcccaagagaactgctattggtttcaggtttaaaataaacctgaatctctacgtaattcaacattatgatttggtacttaatgcaaaagtaagccttcaactcaacatataactggagaagaaaaatttaattccagaagctttccatctcatataggttattactctgccagagtaaggatttactttctcaagcagttggaattcccaagcatactgaagcaagttatagatagcctgaaaagcaatgtgaaaagcaatgcttcatctctgaagcaaaatttcctttcagctttacaatcaatgatgctatcagtgacatggtttttaaattctcgttgagaaaatttaaagg

SEQ ID NO: 391291 - DNA, 135 bp, Homo sapiens
gataagtcatgggaggtgagaaaacggtgagtttaaggaaaagaacagtatcttcaaaatggtaaagctgaggggaacgtgccagaagcttcaggaagatggagtatgcccagacaacaaggaccatggctttag

SEQ ID NO: 391292 - DNA, 311 bp, Homo sapiens
tcaggaatggattactgatgttaatcagaagatgcttatttgtaaaatcctcagaggagtggctggcacagcaaatgtgttggctattacaagcagcaatagtagttaatacttttaaagactgatggaccagatacaaacccaaggctacaaaggggcgagggaaggagcctggatctccttacctggttgtctagaatgcgccagctgcccgggagatgaaaattacaaggttgtgggaagtggtttgaaataatttgattatggcataatttttataatttagaatgataattaaggggtataaactt

SEQ ID NO: 391293 - DNA, 252 bp, Homo sapiens
ctcttcttttccatgtgtctttttgatcagctacagcctgtgttcttgatccatagttcttcatctgtgtgtgagtagtaggaactaagaagatagccttaaaaaaaaattgcctcctatgcaaaacttatactctgaaaactacagaacattattgaaagaaataaggaaggcctaaatgaatggaaacatatccagtgttcatggattggacaacttaatatgattaagatggcaatgctccccaaattg

SEQ ID NO: 391294 - DNA, 522 bp, Homo sapiens
tacaactctggaggctgggaagtcccaaggttgaggggactgcattttgcgggggccttcttgctgcgtcattccatggtggaaggtggaagggcagcagagagtacatgtgcatgcaagggtaggagggagagagagaggaagggcaggagagagaaggaaaaggggctgaactcatccttttatcaggaacccactcctgtgataaccagcccactcccaaaataatggcgttaatccattcaagatggcagacccctttgacctatttacctcctaaaagccccacctctcaacactgttgcattgaagattaagtttccaacatatgaactttgaggacacagcccaatcatagccctggagagggttgggtcttgtggaggggagaggcagctctaggggaggcagctgggggttgccctggcctgtgtaccagacagagccctggctcccagccaaaccctcagctggacactgggtgcattctcatccttcacttatcaccagagcgaggaagga

SEQ ID NO: 391295 - DNA, 502 bp, Homo sapiens
agggaaagtctgggcaatagatcctaggggaggaaaggagcccccggactctgtgttggtagatcctggttcctccttcactgagctctctaagctcatgtggcagctggatgtggtcactacacgtggtttacagctggatggaaaccaaagcacttagagctagatttggggggcccagttaggaggctccctcagaggagctgagtactgagggaatggctgatgttcctagaaagaggtgtaaccaccggccccggagaaaaggtcacagccggtgtggattatcaaagggtgagaggagtcttaaaagggagacattagactccctgctaataaggcctgtggagatttggatgattgattagaagaagaagagacaatgggattcacacttacatttacaaagcagttctgaccagttatactatgattaaacatgctgcctgcctccccatgcatgaggagccgaatatgtattccaaggcaagacaaggacaat

SEQ ID NO: 391296 - DNA, 426 bp, Homo sapiens
gttcccctgagcacaggcctgagaatacttgtggggatggcagccccctgcaggtgtggctggacctgggtagagctggtgagggaagcacgatgcctggacctgctaatggttacgggcctggctgtgaaggcccatctgggcagcgtatccaccccatggagcagccacgtttcggtgacattccaacactggcctgatggtgggaacctgctgagggcccacagccctgccccttggcactcaaggtcccagctgtccctcattaggacccggtgtccattagtcagactgttggtcataggcttccccagcagccctaatgtgcctgtaattagccactgacattttctgtcaccacactactaatactgtatattagagaagcacagacagataagtcaggaatatcagtcactgtaggaa

SEQ ID NO: 391297 - DNA, 359 bp, Homo sapiens
caccaccaccaacaaaaagataaacacaagatataatctgtgtaatcactttcttgtaaaaccagatggttttactacccaagactttctcctatgtcattctagaaaaggatttttccaagaaaactagctataacccacatatcaaaataatacatattctcatattctctctcttacacacacatatatacacaccccacctccaaacccacacccatctttgaatattgtttccctcctgcttaaccttttcagatggagaatctggatttagacaggagagcttcctctccacctctttgcctctccaggaatccacacccatctttgaatattgtttccctcctgcttaacct

SEQ ID NO: 391298 - DNA, 608 bp, Homo sapiens
tatttatttatttatttatttatttatttattgagatggagtattgctttgtcatccaggctggagtgcagtggcatgatctcggctcgctgcaacctctgcctcccgggttcaagcgattcttgtgcctcagcctcccaagtagctgggattataggtgcctgccaccacgcctggctaattttttttaaatttttagtagagacagagttttgccatgttggccaggttcgtctcgaactcctaacctcaggtgatccacctgccttggcctcccaaagtgctgggattacagccgtgagccactgcgcccggccaaagttaaataaaatttaagatgcagttcctcagtcacattagccctatttccagtgcttagtggccacaggtggctgctgtattggacagcacaaatatagaacatttccatccttatagaaagttcaaaattagccgggcatggtggtgcttgcctgcagtccagctactcgggaggctgaggtggggaggtcgcttgagcgcgggaggtcaaggctgctgcagtgagctgtgattgcaccactgcactccagcctgggtgacagagcgagaccctgtctctaaacaag

SEQ ID NO: 391299 - DNA, 613 bp, Homo sapiens
cagggccattgatggggagtgggtaggggcgctggcctggaactatgaaagggggccagagaattgagggagctgtcccagcggggcaaagcccccggagcctctgtggggccagagttagggagaggttaaggcattcagcggtagcctgggcaggaacagttcctggctcattcttagccatccaagagtttcgctcggtggccacaacaggacaagcctcccatctgtctcagctcccctcccttccctggggaagggccatggaatagccacaatcagaaccctttgtgggccaccgagcacagccctcagagtcaggtttaaaagaggcagcgcagtgtgggggaaggaggcgaggggctggtgggcagagaggtgatatctgggatctgtggtggagggagtgtgtcagtcactcggggatgtttatctcacgcctgctgctggcagagctccgagctggaacgtgtctgtgtctctgcacaggtctggtggggaaataggaacaggctgtttaaccaacaaacaagtagtcctgttatacacagacacacacacacacacccatacacacaatcaaacaggctgtctcaccctgggtaccgagctc

SEQ ID NO: 391300 - DNA, 479 bp, Homo sapiens
tgatatatatacccagacacaaaactttttatcaactgaatagccagttgtggattttgagcaataaatggggggggggggggaactactttaaaaacattaagccatgagtttattcaatctgtatctttgtcttctagtaagtaaatttgctttcattgttaaacagcagcaacaaagggacaccaaagatctttgcataccttacttggttgtaaactttttgaagtcaaaggtaatttttctaacttctttgcagtagctaaaacttacatagcagcctctttaagcagggaaaattattgtaaagaaattgctcttagataactttccactcaagggttttaagctttttgttttgtttgtaaaatcttttacgatgagcactttgtaagtctactagttagctcaaagcagttctccttgaggacccacatctactccaggctgggagacagagcgagacaccatcacttaaa

SEQ ID NO: 391301 - DNA, 124 bp, Homo sapiens
ggtccagctatgtacaaactgaatcaagattctatgtacatcagaatcaagagagagtgagttcttgacatcacggagcggtctacattctagttcatgcggtggacctgctgggtggcctcag

SEQ ID NO: 391302 - DNA, 368 bp, Homo sapiens
ctgcccagcaatggctccccatttcactcagaatgaaaatcaaagtgctcacaatgccctcaagtcccccatgctgtagccactaatttgttttctggcctgatctcccactatccctgtggacttttctccatccatactggccttccttttgtctttcaagcatgccaggcaatcctccagcttaagacctttgtactggcagttcctgcgcatggaacattcgtctcccagatgtttgcagtgccaactccctcaccttttctctcgcctggttctattcttttttctgttgcatttatgtttacatattgtatattttactgaacttttttgttgatacttacttatggcaccactcacaggaa

SEQ ID NO: 391303 - DNA, 690 bp, Homo sapiens
cgaacatttacattattttcagatttggaaaattttaaagtgctgctgtgaacatttttgcatatgtattctattctgtgctatataagcatgcatttctataggatataaacctaggaattgctgggtcataggatatgcacattttcaattttagcataatagatgatgccaaacttttttcatcagccctgtaagaaagctccctttgctccacatccttgccaatacttggtatttttaatttcactaaaatttaatctcaattaagagacttcttaaaatttcggcctttctggggagaagtgtgcagtagtaccttgtgtaattctctgaatactgatgtgacggagcaagttttcacatttactgaatatttgaatttcttcttttataaagtgcacattcaatttttgccccttttcctattgattaactttccttttcttactgatctgtggatattctttgtaattctagctacaaacccttttttgacggaaaatgtatacaattaatttggcaccaggtttacttaactttcaggacaggaaacatagcatattagcattacagcatcaggtatgctaggccatattttagttcctcatgtcagttctaaggtgaaagatcaggtgggtaagtgtggaccactctgccttacaaaacacaggatcttgtagcagccca

SEQ ID NO: 391304 - DNA, 422 bp, Homo sapiens
atcaaggaaagttacccaaaatacagcgacacttatgttcagtctgggattcgctctgttgcccaggctgaagtgcaatggtgcgatcatagcttactgcagcctcaacttcctgggctcaagtgatcctcctgcctcagcctcccaaagtactgggattatagaacctccagcccagactggagtgcagtggcacgaacacagttcactgcagcctcaacctcctgggcttgagtgtccctctcactttaccctcctgagtggctgggactacaggtgtgcaccaccacagccaatttgggggtgatgtgtacacctcaacagagaaatggaatacaattcaagagacccccatgaggcggaaattcgggctgtcccattttccagctgaggacacagaggtgcagaggaggtaagtgact

SEQ ID NO: 391305 - DNA, 311 bp, Homo sapiens
atgggcctctttcatcttcccatcatggccgccgcctgtgcgcctctgctgagtcaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcctactcgccaaattatctttaagaactctgatcctcaaatgctcagggagactaatttgtgtaataataaaactctggtctcccacacagctggc

SEQ ID NO: 391306 - DNA, 330 bp, Homo sapiens
atgggcctctttcatcttcccatcatggccgccgcctgtgcgcctctgctgagtctgcttgagatgttttgcagaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcctactcgccaaattatctttaagaactctgatcctcaaatgctcagggagactaatttgtgtaataataaaactctggtctcccacacagctggc

SEQ ID NO: 391307 - DNA, 1316 bp, Homo sapiens
atgggcctctttcatcttcccatcatggccgccgcctgtgcgcctctgctgagtcgtatgtatttccctcctgacattttttttcagatgttccagtcactttatggcctcaccaacagaaatgagattaaaaagaatttgtcaaactatctttaataatgccccttcactctgcctgtgacgtattagtgacctctgagctagagtcttgtagtcacttcctggtgacccctgaccccgttgatttccgtccgctaggttgctctcacccatggcgtttgctggttatgagatttgcggaacgtgtggtggtggtaaagggcaccaactgttgtcaacctgcatgtgggggtctgaggtctggctctacagcttgtaaaatggaaataataatgcccagaggatgaaattaggccacataggccgcttggcatcatagtaagcactcagtaaaggtcaattgttattaaccatttttatacagcgcctttgtttaggtgcagagctttatcagagccaaaagatctctgcgctctgttggaaaagatagttcctgcagtaattattagtaccccatttaatggctaagtaattatagctaacagtgctaggatttctttttcatatatgacttcatttgaacttttcagtactatttgttgatttcataatttttcgagcactgctgttgaaactgcctttgcaaaattacaactgaggaaattatgatagtggaagaaatcagacttaaccgactccatcttgcttctaacctttaagctgtccttattcattcctgggtgtaggtggaactaactttggggaggaattcagtttatggtttgaaacaaaattgataatagccccttcccgaaaagacccccttcttgcctggggaccagtctgtctttacaggactaacaaattagctacaagattacaaattacagtttaggggacatgcagcctctcgctccaagagtctgaacctccccaaattgcttttaggaataacataactattgtaaaacctaagattagtgcttgagatgttttgcagaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcctactcgccaaattatctttaagaactctgatcctcaaatgctcagggagactaatttgtgtaataataaaactctggtctcccacacagctggc

SEQ ID NO: 391308 - DNA, 1248 bp, Homo sapiens
atgggcctctttcatcttcccatcatggccgccgcctgtgcgcctctgctgagtcgtatgtatttccctcctgacattttttttcagatgttccagtcactttatggcctcaccaacagaaatgagattaaaaagaatttgtcaaactatctttaataatgccccttcactctgcctgtgacgtattagtgacctctgagctagagtcttgtagtcacttcctggtgacccctgaccccgttgatttccgtccgctaggttgctctcacccatggcgtttgctggttatgagatttgcggaacgtgtggtggtggtaaagggcaccaactgttgtcaacctgcatgtgggggtctgaggtctggctctacagcttgtaaaatggaaataataatgcccagaggatgaaattaggccacataggccgcttggcatcatagtaagcactcagtaaaggtcaattgttattaaccatttttatacagcgcctttgtttaggtgcagagctttatcagagccaaaagatctctgcgctctgttggaaaagatagttcctgcagtaattattagtaccccatttaatggctaagtaattatagctaacagtgctaggatttctttttcatatatgacttcatttgaacttttcagtactatttgttgatttcataatttttcgagcactgctgttgaaactgcctttgcaaaattacaactgaggaaattatgatagtggaagaaatcagacttaaccgactccatcttgcttctaacctttaagctgtccttattcattcctgggtgtaggtggaactaactttggggaggaattcagtttatggtttgaaacaaaattgataatagccccttcccgaaaagacccccttcttgcctggggaccagtctgtctttacaggactaacaaattagctacaagattacaaattacagtttaggggacatgcagcctctcgctccaagagtctgaacctccccaaattgcttttaggaataacataactattgtaaaacctaagattagtgcttgagatgttttgcagaccctgcactcattggatcagctgactacctagaccagtaacctggctcaatcagttctgccattccacccaggaacagaaaacagcaagctcctactcgccaaattatctttaagaactctgatcctcaaatgctcagggagactaatttgtgtaataataaaactctggtctcccacacagctggc

SEQ ID NO: 391309 - DNA, 1307 bp, Homo sapiens
ctagctattatgagtaattctaccatgaatatttgtgtataggtttttatgtgacgaggcataatattttttaaaaagctcccctagtaattctgatgtgcagtcaggtttgtgaaccattagtctcaaagatgacagatgactaaacagtatttttaattgagttgacaatcatttggtctgtttgtccactgctttatctgtcacttagggcagagtgtagcatactgtagaccctaattaatatttgttaaagtggaaaagaaaaaccaaactccttcagcttagaaacccaatgaaaagatgtttcttttcataatgaaggcaccatttcactagggattcaagatccatacagaagtgtgctatatctttagaaaaaaaaactttttcagacaatttttccaagtttgtgcctgtcgtcatcatggtgatggtgttggggctggtgaaacactgcccactgcatcaattccagagtaaaaactagattgaatccaaaattttctataaattaatgttgacctttactgagttctgagatcaatattaattactgctgtgctttgtaattataaaagggctatttgatgtttcacaccaaggatatgggtggagagagaaaagaacttgtattaacaccatctgtggtttctaactttgtaattaaggccaattcctctgtggaacattttagttattatatatcatgattattcggtctattaatatccagggaagtaccacagtttgagagccattcattctggtttacttggggagtcctattctatacctgttttgctggcataattattaaaagcctctttaactcaaaagtgtcctgttttggataataactcatacagttaccccaattataggtgctattccatgagcacagttactgacttgctacattttaaatgtcatctaaaaaatttttcatttttttcttacccattggatgaaccagtttttcccctaaagacctgccagttgtttttgcctgttcttgataagtgctttgtattgtggcatttagaagctacagctctgctaattggtgtgttagagctttactacttaatctgttgttgaggctaaatccccaaagataacatgtcatctgcctcttctccacgaaatcatggtgaggaatgtgcacctacatgactttgtgagacacgcagcaagactgtcttcttgcagaaataattattcctcaggaggaggaattgcctctggttcttttgtcctttgctcagatcctctcttcattgcctttggctatcttttttttattt

SEQ ID NO: 391310 - DNA, 311 bp, Homo sapiens
acaagtaatatccaatatatgccaaggtacaatacaaaccagaaatttcagccactgctgatgggaaggtaaattgtacaggtctcataagtatttatttgaaatgcttgggactggaagtgttttggatttcagattttttcagattttggtatatttgcacatacataataagatatcttgggccagatgcggtggtttatgcctgtaatcccagcactttggaaggccaaggtgggcagatcacttgaggtcaggagttcgagaccagcctggccaacatggtgaaactcccgtctctactaaaaata

SEQ ID NO: 391311 - DNA, 345 bp, Homo sapiens
agataatctagtattagtttcgtaattactagctagctgcacagcttagttaccctaaacataagtttgttcattttgtaaaatgtataatttcagctgtcccacctgagtcatggtgggtggtagtctgcaaagtctcttctaagtggtaaagcttagtcaaatgtgaggtattatcactggatcttggtgtcattaaggccatttagattatctttacttgtggcccctttatccaacaagggcacagacccagaagggtgtttagacttctgtcatgaagtagagtcattagctggaacttatgcttcccttactaacagtgcaggctggaggaatctgatg

SEQ ID NO: 391312 - DNA, 644 bp, Homo sapiens
agtcaacctttcaattcacccttaatccatccgtgatttccttcatttatcacaataattcactcatttattcacctctgatctacttatcattcaatccagcctttcatttactcctttatttactcatacttcactaatttaattattcacttgctcttccataaatctagccattcatgtgattattcattaattgggttcattgatttctttgtctatggatcattcattagtgattaattaatcaatccatctattaattgataagtaaatacagacatccatttattggtttgttcatttattcatcaatctttccatccatgaattgatctattgattgattgattgatgtttttatccagttgttcatgaattcatctattgttctattacactgttatatacctgaggaccaagaatagtgtctcaactatattataaacacaataaatattagttcattttctactcatcttagagagggtgttttgagaggtttgtagcctggagttcttaatctgaaattccatgcaaaatcgtggtgtgtgtgtgcatgtgtgtgtgtgtacctgggcatgtgggaagaggatctgtaatattcattagatttcaagcagtgagaattcttgttgcttcct

SEQ ID NO: 391313 - DNA, 358 bp, Homo sapiens
gagcgtttgcatacacttcgtgtctgaaaacttccaggattcccaagattcatttcacaaagacttttctcgtaggacaggtatttgaaacatctggttaacaagtacccagcttgaagaaagcctggatcttcacagcacgctcagtttgtagaagagaaaaaccctactctgggctctaatttgcttcagctccattaaacacatcctgagccctgctgtgtgccagacgctgtgctgaatacctggcaccagaagaccaatcgggcccagggcttctccccaaggagcttcctggccaggcggagacacccctggaatagaccatttaggagcctgaggcctgcatgtagcattt

SEQ ID NO: 391314 - DNA, 894 bp, Homo sapiens
agatttttttttttaaatatcattttaaggcagttaatgtttttcctactacaggagtcatggatcttattcccagatactgaataaaaaattctgtcagttggggtggctcacgcctgtaatcccagccactcaggaggctgagacagggggatcacttcggggcaggagttcaagatcagcctggacaacatagcaagaccccatttctttaaagaaaaagtttttaaaaattagctgggtgtgctggtatgcacctgtatactcccagctgcttgggaagctgaggcaggaagaacctaggagtttgaggatgtagtgagctatgatcacatcactgcatctgcctgggtaacagagtaagaccctgtctcttaaaaaagaaattcgttagcactggcagttttaaaatgtgagccatgtctttcaaggaagaatacctcttatatttatgtatacaattaggaaaacccagcacacgcatgtaatatgtgttttgaggaagtatatgcagatttccaagtcagtttcttgggttagtagttactctgttggcaaaattaaatgcaaattgttgttgtgctcctttgaagtgtctaaagtatatatgacctcaagtggaaggatgactttttcctacttactctgattctaggactcttcagacttttctgattgttttattatctttttgtgttgtcagggtattagttcctctgactatgaatgaaatctcacatgagggtttttttccctcccttagagtcttaaaaagtttttaatttcatttgagttggttgcaagtgtttggctttttgtatttcagaaactttattgacataaactgaatatgtactgtatttttatttgaactgtcttgttacttagtatagt

SEQ ID NO: 391315 - DNA, 593 bp, Homo sapiens
gattgttatgagtcccagagcaaaagttcaatcctctttcacatttctcaactcacctcagcccaaacaggaagaattagtggctcccttgtgttgcccacagccccagaaccctttgcacgtcgctccaggattgcaccgtaaccccagttatgatgctgattctttaatccactgtctcctgctcctgcgctgggggctgctcttcccccacggtatcatataatctttctgacccaattcctcaatttctcagtaactggtttccaattactcagataatggggagggctgtgtggccaccgccctctaggaacctcagtttccttgtctttaaagcaagaagcctcgcgatcccagcactagcacccagctcttgcacacttgctcggtgccaggctctactctaagcacttcacatgcactgagttgctcaattctcacaatagtctgagacggggactcatgagaggcacagggtggttaaataacatgtcacagtctcacaacttcacactcactcttagcagtacctagccagtgacactcaataaatgtcagctattgtatttccctatacttactattcttat

SEQ ID NO: 391316 - DNA, 475 bp, Homo sapiens
cacattaacttggtgtactgtttcataagactcttacaaagtcatcctaattaaagacatgttaaatataagaaaaaggctttagaatcgataaaatacacagtatgtaggttttaaaaaagctatttgtaatactatatctcaaactacctttttccatttttggaacacttgggttggaacacagaaccctaaatgttaacgctttctttattgtaactataaggcagtggttctaaaatgttgctgcacaatgaaatcacctagagatattttaaaaataaagatgcctggctccctttcccaaacactgacttaattggtatggagtaggagctaagacacaggcttatgaaaagcttcccagctatttctaatgtgaggcaaagtaaccacgggattcaagtgaattaatgtcctacaattcagaaataatttacagattatatagattagtatttttcctttttgggca

SEQ ID NO: 391317 - DNA, 371 bp, Homo sapiens
cgagaccaccctgggcaacaaagcaagaccccatcgctacaaggataaaaattaactgggcgtggtggcatgtgcctgtagtggtcccagccactcagaaggctgaggcaggaggatcccttgagctcaggaatttgaggctgctgtgagttatgattgcaccactgcactccaacctggatgacagatcaagaccttgtcttaaagaaactctggatggtgattttttctagagaggatataattttctggcaggcagatggggtacagttggatcaaggttgatctatttctgctttgcctttattcctagaaaatatccctagggtctcagctgagagcctatggtgtttaccaggccccttcaaccc

SEQ ID NO: 391318 - DNA, 232 bp, Homo sapiens
ccagtttctgtcaattggaatgtatttctgttaatgtcttttacttgggaatttaatgccttttccatcttaaatcacgtactgtggccataacttttgcagtttgaagtatgacagcaaaactagcatgaatttatttttccttcacaatttgatgtatagaagattttttttaaaaccatagatcttagcaacttcaacatacgattttttttccttccttattaagtca

SEQ ID NO: 391319 - DNA, 744 bp, Homo sapiens
agcggtctttcgatagtggagctctgaaggcatctttttcctgggcactggcagaaggagctttcaattatactgtgatggctttgagcgactcttcagagctgacctgcagtacaactttcagttcctgcaccatctcttccctccagtgtggaactgaatacttgatttcagttttagcaagtaatgatgctggatctagcaaatcatcttcagcaatgaccctgaaaactgttgcttgtgcacccggaagagtgacgatccaagaagatccccctggccacctgtctgtggcttggtccagtgtagatctgggtgactactatgtggtctttgtgaagagtgatgatggcttggaagtacactgcaacacatctctcactcagtgcaacttcttatctgagtgtggcttcacttattttattagtgtttttgcctataacaaggcagggcaaagtcctttgggtgacatattcaattataccacagctccctgttgtcctagtgacattaaccccgtgttggtgtccagtgacagagttgagattgtctggtctcctgtccgtggtgccgaactgtatgaaaccaagggctgtagatgggtacaacatggttgagtgcaatgacactactcctgcgtgcaccctttcggctctagagtgtgacaccaagtacaacatcacagtgtattcattcaatgaagtccgaggcagcaatatgtcatgtactccccagttcataacc

SEQ ID NO: 391320 - DNA, 382 bp, Homo sapiens
aaacttgaaaccctctcatacttggcatagcactgtgcaattatatatttatataggcataataaggaaacaacatttatatagacataataatgaaaacattgagtatgcatataaccaaaaattctgaaataacgacattgagagtgatatgcagagaatggaggtaggggattagtacgggatataagaactaatgtgctcatataccccaatgagaatagacaaaggggatgaatcaagagacaatagtatatggatattatttagaaatatggtgacaaatagcaaaattattgctgctacaaaagctgacttggggtaaggtcatgctggggggactctgatatttgttcatatctgttagtactacttgactttt

SEQ ID NO: 391321 - DNA, 286 bp, Homo sapiens
tgaataggagtttgctagaaagagaaatcagaggaaacagcatatgcacaggctcagaggctggaagcacatagtctggtgcaaagtaggtccttgagaaaaccctggaggccgggtgcagtggctcattcctgcaaccccaacactgtgggaggctgaggcaggaggattgcttgatcccaggagtttgagaccagcctgggcaacatggcaaaatctacctctacaaaaaatattaaaatgttagccagacatggtggtgcacacctgtggtcccagctactcg

SEQ ID NO: 391322 - DNA, 214 bp, Homo sapiens
tagtagagacagagttccaccatgttggcctggatgatcttgatctcttgacctcgtgatccatccaccttggcctcctgaagtgctgggattacaggcgtgagccactgtgcccagcctctaactgctttctttagggagaagttggcactcaaaaactctgtttagacagttgtaaaaaaataaaaaataaacacttatctgaaatattcta

SEQ ID NO: 391323 - DNA, 957 bp, Homo sapiens
cttgactcatcaatgtactaagacttgagtagaaaggcatctcaagtgccagggacagaaagccccagaggtagaaaaatgtatgcttgtacgatgaacagcaaataaaccagtaagtatgggtgagaggagtggaagacgaagctggagcgataaactgggagctctctgtgaagctgtagggagtttggattttattgggcgggaaatggagcatcatggaaagcctgagttggggtaggggaggaaatattcaaggcagcgatttctgacaaatagtctagtggtgatatactgggtgaattgaagaggaaagaatgactggaggtggaaagaccacttaggaggcagttgcaataattcaggcatgatgttctatgagcctcaaccagggtaatgggagagaagaggcaaaggatgaatgaaaggaagctgacagaactgtaggcagaagggggaaggcagcattaaatacaactctgaggcctcccagccatgggtgacttaggaaaaggatcgtcccattagaccatagaaatagaccatttagaaggaagaactggttgtagggtgttttgatgaaggccagcaaagcatctcagatgatttgtatgtttatagaatgagaagacaataaaacatttttaaaagtcagagaggacaagagagttcagaggatactgtgatccaaattaaggaagacaataattttaaagatgtcaaaattgcagaatagtcaaaggcaatgagaagcaaaaaaatagtcactggattaaacaatagggtcatcaggaaacagtaggaagaaggcaaatggtagagaaaaagcagtgcagaaattaaaggagagagggtcggtcaactgttttatagggaaatttggtactgaaggaaggagactagtagtttcctgggagtttcagggaataagaaaacccagaggaaggttgaattggg

SEQ ID NO: 391324 - DNA, 234 bp, Homo sapiens
atgaagtgtcacgttggaaggcaggatgctttgtgccccttccagcaagctaacttccaaataaattctctatttttatatcagaccttgttcttgttaattagactttacatgaagtgagcaactaagcttttctgttacaagacttcatgcccacagatacattcaagtcccaggtggaaggatgatctagatcaggcaaggtgctgaccatgggaacaggagacagtcaag

SEQ ID NO: 391325 - DNA, 306 bp, Homo sapiens
ggaatattaataggaaaattaagaagcgggcagaggaaatggaggcttggtaacctggctacctgcccagcaacccaggctagtgtaatgtgaactgcagctcagcagagttgtaagaggtaaaatgggcatttgtgggctatcttaggaatctagacactattttccttatggagaaatgcatttcaagtacatgtggagtaagaattggtttttaaatgaattttgttccttgaaagatggtgctgcctacgtgtcattccttaaatttgttggtaaggctttttgatgtaaagtcaccccatg

SEQ ID NO: 391326 - DNA, 240 bp, Homo sapiens
atgagttattatgaaggtgcttagaataatgcctaatccataatctgcacttaataaatgatgctgttgagggaatgggtgttgtctcagagcaggtaggagctcgccatgttatctgtccttatttcattgtctgccacaggctttggggtcagaaggctcttgttccacattggttctccaagcatgcacattttaccttataaaatttacttaaactttctgagactcagtttcctc

SEQ ID NO: 391327 - DNA, 527 bp, Homo sapiens
ggctgcagtccaggcaggccccacccagtaccccacttttccttcttgctccctgcagtggctctcccccggcattgtcgcttcaggattttacaactcaaattcccacatggcgtcccggcctgggtgtctgtgggggtcctgagcccgggcacccctctttcctccatacttgcccacagcagctctttccatttcctgccgcagcctctggagacaccacacgccacggatttggggcagatgttggacagggcctccaacactcaggcttaccaccctgttaggggaatgtgagccagagagggtgagcagctcagcttgaggtcacacagccagatggaggcaattaggttcgagccatagtcggctgcatgccaccctcctggtcctagctctggccattgtctacagggccccacaggccccctacctccccttagagggcagagaggaaactggctgtgcccccatctacagaggcagggctggcccgcaggtcctgggcccaggaactggggggctcc

SEQ ID NO: 391328 - DNA, 258 bp, Homo sapiens
tgctgggattataggcatgagccactgcacctggccctgcggcattttttgatatgggatgatgtgtatcatttaaaatctgacttcaactgatttgggcaatatttcttagccatagacaaagaatgagtctgttgtgtgaagatgcctggttgagtgttataggagtcaggataaggtcacatttactttattggatgttttattccatatcttgactcaaagaaggcaaagggcaagataatgaaatccattggt

SEQ ID NO: 391329 - DNA, 605 bp, Homo sapiens
gtgttggcatgtatctggctgggctgcacatatatttgatattcttagataataggagtaaatagaactgtttagaagttctaaagagaggtttcagaatatctaagaggcaaaatattctgcacccagaatgtgccctaatacccagaaaaatgtgtcctagaattgactctgagtgtgtctgaacaataacaaaacttggcagtccttaagcgtaggttaatcccttttagtatttgtgcttttaataccttaggcatctcctcttatcacaaattaataagtattagtgttttatataaggctgctttccccagtcatgtctgaactccataatgggatccagaagtgtatggattatctggttttcactcagcagtggctctttgacacctctcaatgcatggtaccaaaaaaaaaggtccatatagtcagggcacggtggcacataccttataatctcagctactcagggggcttaggcaagagaatcacttgagtctaggagttcgtggctgcagtgagctgtgatcatgctaccacatttcagcctgggtaatggagcaagaccctgtctcttatgaaaaaaaaaaaaagaaagaaaa

SEQ ID NO: 391330 - DNA, 243 bp, Homo sapiens
cagagcatggtgagagtaggagcaagagcaaggcagagggataccacacacttttaaacaacatgatctcacgagaactcactatcacaaggacagaaccaagaggatgacgataagccattcatgagaaatctacccccacgatccagtcacctcccaacaggcccacctccaacatagaagattacatttcaatgtgagatttggaaggaacatctaaatgatatcacttttctaacccaa

SEQ ID NO: 391331 - DNA, 591 bp, Homo sapiens
tctctgacctgagaggttctgtagtgattatttttgctgccctttctctaggctgctcttaaaatggggcagtgaattttataaatcagaactaaatatgttttaaagcatcttgctataatgcctcagcactgcgaaaaaatactggtatttctaaaagaatttagagttacaaatatagcaactgaaaaaaatcttcaaaaacattttctgtttccactaataacattagtttgagatgtttagaaagcataaaggattaaacatgattttgttttagttgttgattttgagaatgagggctttgtgttttccactgagggatttgggtgcatttgaaaagatcttaatgttattctcataacagcgacttttgggtaatgtaaataagataacaaattgttatgtttagtttaaactcatgatacttaagcactgtttactcattgtcattaactattccaaccttaaattaaaaatgcttaccttaattaaagctgtattcagacaacttcctatggttatccctgcgttgaatttcttgtgcttcttgaaggaggattacaataaagaaacccttcttttatagtt

SEQ ID NO: 391332 - DNA, 505 bp, Homo sapiens
tataagaaaaacataggacaattcaaattgttgtgacagtaaaatattaaatattttcaaatggtccattaaactcttgactgaaatggtttaagaaacaatgttagaatgacatggtttcacatttaacagttaacaaatggaaatatcaattaaaatctggggtgtttctcactgagctcagccagtgctatgccaatgaagtgaactaaattctctggttctttgtggaaaatcattctgaagtttttgctctaaaaatagcttttggggcctgaattaccccttaccccactcgaacttctgtgcaagagccagaggaccagtgattactcgtggggccttgggcctacttaagagactcaacttgggtgttcacaggactgttgactttaattctaaaaaaatttattaattcaacagagatttattaagcacctgctctgggaaagggctgttctagacactggagatccatcaatagacaaaaatagtaaaaaaaaaa

SEQ ID NO: 391333 - DNA, 324 bp, Homo sapiens
ccttagacgggttctgttcgtgatctctgtctgcctggctttaccagactctcagcttcatcatctcatctcagggaatctggtggactctatgtcagttttttctctctgtgcggtagcctggaaactccgtgaaggcagggagctggagtgtgggatgaatttccttggtttcctgtcttacggggatcatggtcttcattacctgaagtccactgccgggtaaatcatggtataatatatttggtctgttttcttttgggtggtttcaggcaagaaggtaaatcagtacttgctgtccatggtggccagaagcagattcca

SEQ ID NO: 391334 - DNA, 338 bp, Homo sapiens
actgagtacctaccatgggccagggtagcataggagggaagaatctggagtatgtggcaaggtctgattgactgactctcccctccctcactcccaacaactgattcgagaactaacttcatactgtctggccaagacatttcagatctttatgtgggctgttcctggaaggttattggctgaggttcccagggcaaatgttaggggagttggcttgaagtcactacccgacctggggagacagaaagataatcacacacacacactcacagtacagtcacacacacacacacacacacacacacacacgcacacatgatgagcaaggcacagttgca

SEQ ID NO: 391335 - DNA, 421 bp, Homo sapiens
tgctccttgtcctcaagctcatgcaaatgggtttctgtttcttacaatcattgttcccagatatggatggtgactgatgctctactaaatgctgaaaaaaagcagagtggaagcacagaaaagtgggcttctctgaggaggtgacgttagagcccagttggaaggcaggaataaatgtgcaccatgactttttaggattaaaaccaagtacctcacagcttgggcacatgtagatagaggtgatttaacagtaaagtgtcccagttgtacccattgtcagttacctcaccacagggtttatgtagccctgagtttgcttagtgcttatttattttaggttgttgtttatccaaacctcttaaatgatatgtgtttggaacaagtaacagcatcgttcattgatgttgtggacaaaccacta

SEQ ID NO: 391336 - DNA, 1015 bp, Homo sapiens
gggagagtcctaccaaactaaaactaagatacctcctttattccttccagctgacaggacatgagccgtatggtagctctcttccaagaccccgcagcctggggtaataaattctgccaagctctccctctttctctctctgctattccctgaagcctgacaaccctgcgggtcagccccctagggccatccagcctccgtcgcccgatgccaattttaccttgtgactctcacaacagggggaaaatttagcattccttggagaccgaatgggatgccgtgagcttaagcccttccaagagcttagcaaccagtctgtccttattccgtcccaataacacagcccccgatggaacaattacaaaagtatttacaacgccttacctcttactgttcttatagatgtacttattcctgtaggtagactctaaaaagtttgaagaggaaaaattatgaaaatcaagagggagaagttgttggaaacagcgagttcctcttctgaggttacacttgtcctctgttttcaaagcctaacttccttgcctccttgcccctagttaggataaacaaccttccagccatttccaatctgtaacccacatccattaacccacatctgttcccaatctgtaacccacatccattcccaatctgtaacaactcacatctgttcctgatttggtacccttagttccgaagttgctctgtagcccccacccctgctccatttgaagtagtcaatgaggatcagcttagattgtgtcgtcggaccccaacctatggagactggacacagtagcagggactgactatgttagagacacaaatccttcccttctttgttctgtgcactctcgccattgctccctccatgaggcccacccttctttctttttttttttttttgagatggagtctccctctgtcgcccaggctggagtggagtgcagtggcacgatctcagctcactgcaacctctgcctcccggattcacgccattctcccgtctcagatt

SEQ ID NO: 391337 - DNA, 337 bp, Homo sapiens
tgagtgccaccatggcagcaaatggtatctgaaactgacagactgtagattaaaactttcagaatgtaaggcctagtctagggaaaatgaagttatgtataggtgacttgttccatttgaattaatcaaagggctgctggtgtagaccagctgtgttctctgatgacaaaaacgaatcttgacattttagataatgaaattcagttcagcacctcttagagatatgtgtgataatatatgtcagtcagaaacagagagaaggggagaagctcaaaccttgtcttattaaaatagacattgtgacaagtggacattgctgaatctctggtttctaggg

SEQ ID NO: 391338 - DNA, 479 bp, Homo sapiens
gaatgttgacagtatattctcttgtgaatttcaggttatcgtctacattattgactcttctttctgtgtcatgcctgtggtcaaatcctcataaggaatatatcaggaaacaagcttcatttttaccttataaaataaactatgtcccaacattttctaagtttcttctttgcaactcagaatacatttttgtattatccttagagtagcccacaaacatcccttaaccctaaatctggccaaaatactgccaagtaaatttcatttacttgagaggcttgtcctcagtaagtactattgagtatttccattatcaatctgtcaattttcatggtatacactgcattgattagttgtttttctttgtgtttttcccaaaagtatgtcagctcagcaagagcaggagctgtgtctaccctgttcacctctgaacctccaatgcctaaaacagtgtctagcacattgtagaggctcagtta

SEQ ID NO: 391339 - DNA, 589 bp, Homo sapiens
gcaaagcgggcagtggaggtgagttctctcagccaaatggtctctgatgcttctgggccctgcaacgggagctgatagactggcttttcttgatcgtatgtaatcaaaaccaagtgacttttgaaaaaaagtctctgagatgatttctatctgggactgtgtgggtctcatgaaaaacagaatttttaaaatgactgatgtattggcacaattagtgcttgtaaatatttgttcgtttgaaggctgtgcccagtgatctcacagatgaaactggcttccatctcgcctcgcagcttttacaaaatagcaatagcaggctctcagagggtttcagatctgccgcagcaaagagttggaagatatatcctgtgctgggaagcatgagaggtttttgtgtctctttgattttttttttttttaagtagttaagctcaagcacatctgcagatctaaatgggggagaaatgccatcctgttcactttggcatctgtggtcagaaggagcagaacatacaccaggaaaacaagccaagaccgggttgttggcaggcccctcccagctgcacccagttgagcacatgcctgatac

SEQ ID NO: 391340 - DNA, 445 bp, Homo sapiens
gtaacatttctactgaaaatgctctcagcagtttctaattggaatatttctggagagatctgcttcttccatttccaagccattgatgatgctcattaggcttgcggttggggatgtggcaggaggggaaggggaagaagctacaggggactcaaagggcatcaggaaaggaggaggggctcaggacaggcctgggatggggagatggggctgaggagggagggacaggagcagcgatggaagcagaggacagggctcatgccactgagtgatgtgtattggggagaagagtgtaggtggtggtcgcgggcgataccagggcaggaggtcctcaaacgctggccggcagagtttgcttttcctctgtcttcaagccatccctccctgcaccgcaagacccctgtttatggcgaggcactgggctgggtggggagcgggggagaag

SEQ ID NO: 391341 - DNA, 621 bp, Homo sapiens
cgcggttgttcacgcctgtaatcccagcactttgggaagccaaggcgggcggatcacttgaggtcagcagttcgagaccagcctggccaacatggtgaaaccccatctctactaaaaaatacaaaaatcaactgggcgtggtggcgggcaccagcaatcccagctactcgggaggctgaggcaggagaatcccttgaacctgggaggtggagattgtagtgagccgagatcgcgccactgcactccagcctgggtgacaagagcaagattccgtctcaaaaggaaaaaaaaaaaaagcacaacaggattacatactgtgaaaagatatgtatgtcaagagaactagccacgttcacaacacgagccacagactgggagaaaatatttgcaaaagacatatctgataaagcactgtgacccaaaatataccaaaaaaaaccctcttaaaatgcaacaatatgaaaatgtacaacttgattaaaggcgggcaaaagctctgaacatacacctcaccatatgtatatgcatatgaaaagatgctcaacatcatgtcattaaagaattgcaatttaaaaaaacaaatactattacacatttattagaatggctaaaattcagaac

SEQ ID NO: 391342 - DNA, 342 bp, Homo sapiens
tttagtaactaccattatatatcactcattaggtctatgctgtttgctccttccctattaatccctcctcccactactaacaagcactctatcagggtcagagtgaggtgtggtactggaggtactgaaatcctatcactcatctcctccaccctgaccaggctctggctgacaagagtaacaatacaaagtagtcaaaagagaggcaagggatccacttttttaaaaaagctctctggtattaactacattacacaatgcgggacatctcttacctcctttgcctgccccaatcttagaacctgtatcaggttgagactcagtctcaagctaggactgaag

SEQ ID NO: 391343 - DNA, 315 bp, Homo sapiens
gttagccgtgggctgtgggcgtcgcctgaacgtaccaggtattgtggctccattggctgaggatgcttctccagcgaaggaggcagggagccggggaagtggggtggggtcgcgacaccgacagcagctgccagaccagccatgctgcgctcagctccctcaggctgtcactcttaatcatcatgtcactatctctggggcgtgtcagtcaccatcaacgacgtgtcccccaagctgcagaggacgcaaatccagctctccaagaggctctgttggccctctccacatgggcttgaggtcaggggtgggggcacg

SEQ ID NO: 391344 - DNA, 522 bp, Homo sapiens
gcagggttctagtcatttaagatgtacctgaataaaacaaagagccttactctcctagaacttgtgtttctacctggggagactgtcagtaaaccatccacaaaataaatacagcagatgctgttagaagatgatggtgctatggtgtgctgtggaaaatagagaaagtagagggaagtgagagggattgcgtacactaggattgtgactttacacagaagggtcagtggtgccattttagcaaagatctgagagaggtaaaggaataagctttgcagaagtgtgggagacaaatgttccaggtacaggaaatgaccaacgccaagaccctagggtggcaatgtgtctgctttgagttctagagaaggggtatattatacatcgctttttgtgactcactttttggcaaacattatgcttctaaaatgaacctgtattttggaatatatctgtggttcattaattctcatctttgtacagtattctattatataaatacaccatgatttatttagtcaatta

SEQ ID NO: 391345 - DNA, 257 bp, Homo sapiens
ccttagtcttttacttgtaagctattcctgaagaaggttgcctcagcaggggaaaactttctgaaaagcttgatcaagtacctgggtcccaagaatgtcaagcatctgtggaacacacagttcccagcagccagcaagtcccacactgctcagtgtcctgcagccaaggaagctgaactgagctcatggggttacaggaagatgaaacaacactgcctcactggcaaggagatcacactgctgagtgctgcctgagt

SEQ ID NO: 391346 - DNA, 429 bp, Homo sapiens
agtagccggcccaagttatagaaaaaaaaggaagaggaagactgacaaggtagttgaccttggctccttaaaccacacctgaaagactatctctacctacctgtgtttgactctggctctttggagtacacctggcatgccagatctacctacctgagcctgatgttggctcttcagatcatacttggtgggccaagtctgcctacctgtgctcaatgctggctcctgggcttgtgcctggtggaccagcaccccctacctgcatgtgatgagggttcctgagcttgtaccttgtgggccagctctgcctacctctacttcacacctcagctgcttacacctcatccaacacacttggttcttcttacctgggcttgactatgactttttgggtctcatgaacacactcagctttgtgaagctgccctg

SEQ ID NO: 391347 - DNA, 3665 bp, Homo sapiens
cttttttttatgcatgatggtgacccgccatttgctggcataacccggggccctcactggaaggtcgggtttcggacctactgccaaccatccacaatacatatgctgacaaggcctcacatctcattaacagaggcagttctattttttcttttttttttaagagacagggtcttgctctgttgcccaggtggagtgcagtggcatgatcacagctcaccgcagcctcaaactcctgggctcaagtgatcctcccatctcagcctccccagtagctgggactacaggcacacaccaccatgcttgactattttttaaattttttgtagagatggggtcttgctctgttgtccaggcaggttttgaacacctggcctcagcctcccatctcagcctcccgaagctcagggattacagccatgagccaccacacccagcccagactcagctctagaaactaaacttcagcacacagccagccctctggctgacagagtccaggctgctcaccttggccgagaacaggtcctcagatcccagttttgtgacagcccagcaatgccaagcagtgtctgacctgagcctccgaaccctcaatctgcagacatgggtctctagacctcacctttaagtgcagtggcctctgagaccatacattatagatgcagctcctcagtcagttcaatgtcctgggcctaacctgccccagtgccccagatctcaccttatctaaccatcatctacctttttcctcactttactcactttctttttttttgagacagggtctctcactctgtcgcccaggcctgagtgtagtggcatgatctcagctcactgcaacctctgcctgccaggttcaagcaattctcctgcctcagcctcctgagtaactgggattacagacatgtgccaccatgcatggctaatttttgtatttttaggagatggggtttcaccgtgttgaccagactggtctcaaactcctgacctcaagtgatccacccacctcggcctcccaaagtgctgggatgacaggcgtgagccactgcgcctggcaactttcctcacttttaactcagaccctgtgtcaactggagcacaatgccatcttggatgcagaccaacaccatggactggttacagatcctcagccctctgtattaccctgagctctgtctatcatacctgaccagggtgctgagaacagatacctgtcccagctgatctttagggttccctagacatcaccaggcagacccaggtacaaacacctacaatgactacggctttcccttgatataagagcccacactactcacctaattgtgtctgaccctaccaccgaaggtctcacctgtgtctgacccaccttccccaggcctggccagcctcaccattatgcattcctgtgctagaccccacccacttcacctaacaagcccagcagtacttttgtgcttgaacccaggtgtcaagaacccacctgagaccatgtttatacaacctctgtggaactgagcctggatccacagactcactgctaatgtcaggtcaacataccagcactgagcctgaatccacagactcagtgccaatgctaggtcaacataccagcactgagcctggatccacagactcactgacaacaccaggtcaacataccagcactgagcctggatccatggactcactgccaatgtcagctaaacataccagcactgaccctggatccacagactcactgacaacaccaggtcaacatgccagcactgagcctggatccacagactcacgacaacaccaggtaaacataccaccattgagcctggatccgtagactcactgacacaaccaagtaaatataccagcactgagcctggatccacagactcactgacataatcaggtaaacataccagcactgagcctgcatcggcagactcactgacaacaccagataaacataccagcactgagcatcgatgcaatggtttcacctgggagacctagttctgcctatttgtgtccaactccagtgcctcaggctacagagttatatacctgtcaaagatgggttccagacatctcagctgatagaccaggcttcacataacctgacccctcacaccttgactgacagacccggttcccttgcctaagcccaactcagattccttacagcctcccagggtccagctttatttatgtgagcctggcctcggcagtccacatcctgtgtctggcttggcttttcatgtctcacagacagatccaatgctgccaatctctgcttaacgtcagcaccaatgagctcactgaggagcctcagacctcatcaaatggaacatctctgcctacctgtgctccccagctgagatgcgtagttctaccaacttgtgactaacccactgtccccaggcctaagactgagtcagcacaactaagccagaaccacgcaccaatgacctcacctgcaagaccccagctgtatgtctctctagctacaaagtccttgcttgagagagatacatctacctacccacgtctaacttaggggccacagacctcctaggaaacccacaatgttctgcctgcctgtagagacccccatgctatggggttgacctgggaggccgctctatacacctaggctcaactctggttcttcaggcttcacctcaaacacccaggggcacattcctgtgcctgaatccaactcctgaaagagccaactctatctacctgcattcaacctaactcctcagctctccttcaagagactactcctggcagaccagttttgtctacctgcctgaccctggctcctcagaccacacatggtgggccagctctgcctacctgtgcttgaccctgggttctcagaccacacctgaaaggctatctctacctacctgtgcttgaacctgggttctcagaccacacgtgaaaggctatctctacctacctgtgcttgaacctgggttctcagaccacacctgaaaggctatctctacatacctgtgcttgaccctgggttctcagaccacacctgaaaggctatctctacctacctgagcttttcgctgggttctcagaccacacctagtgacccagactacctacctgtacttgatcctggctcttcagaccatacctggcaggcagctctacctacctgagtctgaccctggctcctcagaccatacctggtgggccagctttgcctacctgtgcttaccctggctcctcaaaccacacccagtgggccagctctacctacctgtagttgaccttggctccttaaaccacacctgaaagactatctctacctacctgtgtttgactctggctctttggagtacacctggcatgccagatctacctacctgagcctgatgttggctcttcagatcatacttggtgggccaagtctgcctacctgtgctcaatgctggctcctgggcttgtgcctggtggaccagcaccccctacctgcatgtgatgagggttcctgagcttgtaccttgtgggccagctctgcctacctctacttcacacctcagctgcttacacctcatccaacacacttggttcttcttacctgggcttgactatgactttttgggtctcatgaacacactcagctttgtgaagctgccctg

SEQ ID NO: 391348 - DNA, 3187 bp, Homo sapiens
cttttttttatgcatgatggtgacccgccatttgctggcataacccggggccctcactggaaggtcgggtttcggacctactgccaaccatccacaatacatatgctgacaaggcctcacatctcattaacagaggcagttctattttttcttttttttttaagagacagggtcttgctctgttgcccaggtggagtgcagtggcatgatcacagctcaccgcagcctcaaactcctgggctcaagtgatcctcccatctcagcctccccagtagctgggactacaggcacacaccaccatgcttgactattttttaaattttttgtagagatggggtcttgctctgttgtccaggcaggttttgaacacctggcctcagcctcccatctcagcctcccgaagctcagggattacagccatgagccaccacacccagcccagactcagctctagaaactaaacttcagcacacagccagccctctggctgacagagtccaggctgctcaccttggccgagaacaggtcctcagatcccagttttgtgacagcccagcaatgccaagcagtgtctgacctgagcctccgaaccctcaatctgcagacatgggtctctagacctcacctttaagtgcagtggcctctgagaccatacattatagatgcagctcctcagtcagttcaatgtcctgggcctaacctgccccagtgccccagatctcaccttatctaaccatcatctacctttttcctcactttactcactttctttttttttgagacagggtctctcactctgtcgcccaggcctgagtgtagtggcatgatctcagctcactgcaacctctgcctgccaggttcaagcaattctcctgcctcagcctcctgagtaactgggattacagacatgtgccaccatgcatggctaatttttgtatttttaggagatggggtttcaccgtgttgaccagactggtctcaaactcctgacctcaagtgatccacccacctcggcctcccaaagtgctgggatgacaggcgtgagccactgcgcctggcaactttcctcacttttaactcagaccctgtgtcaactggagcacaatgccatcttggatgcagaccaacaccatggactggttacagatcctcagccctctgtattaccctgagctctgtctatcatacctgaccagggtgctgagaacagatacctgtcccagctgatctttagggttccctagacatcaccaggcagacccaggtacaaacacctacaatgactacggctttcccttgatataagagcccacactactcacctaattgtgtctgaccctaccaccgaaggtctcacctgtgtctgacccaccttccccaggcctggccagcctcaccattatgcattcctgtgctagaccccacccacttcacctaacaagcccagcagtacttttgtgcttgaacccaggtgtcaagaacccacctgagaccatgtttatacaacctctgtggaactgagcctggatccacagactcactgctaatgtcaggtcaacataccagcactgagcctgaatccacagactcagtgccaatgctaggtcaacataccagcactgagcctggatccacagactcactgacaacaccaggtcaacataccagcactgagcctggatccatggactcactgccaatgtcagctaaacataccagcactgaccctggatccacagactcactgacaacaccaggtcaacatgccagcactgagcctggatccacagactcacgacaacaccaggtaaacataccaccattgagcctggatccgtagactcactgacacaaccaagtaaatataccagcactgagcctggatccacagactcactgacataatcaggtaaacataccagcactgagcctgcatcggcagactcactgacaacaccagataaacataccagcactgagcatcgatgcaatggtttcacctgggagacctagttctgcctatttgtgtccaactccagtgcctcaggctacagagttatatacctgtcaaagatgggttccagacatctcagctgatagaccaggcttcacataacctgacccctcacaccttgactgacagacccggttcccttgcctaagcccaactcagattccttacagcctcccagggtccagctttatttatgtgagcctggcctcggcagtccacatcctgtgtctggcttggcttttcatgtctcacagacagatccaatgctgccaatctctgcttaacgtcagcaccaatgagctcactgaggagcctcagacctcatcaaatggaacatctctgcctacctgtgctccccagctgagatgcgtagttctaccaacttgtgactaacccactgtccccaggcctaagactgagtcagcacaactaagccagaaccacgcaccaatgacctcacctgcaagaccccagctgtatgtctctctagctacaaagtccttgcttgagagagatacatctacctacccacgtctaacttaggggccacagacctcctaggaaacccacaatgttctgcctgcctgtagagacccccatgctatggggttgacctgggaggccgctctatacacctaggctcaactctggttcttcaggcttcacctcaaacacccaggggcacattcctgtgcctgaatccaactcctgaaagagccaactctatctacctgcattcaacctaactcctcagctctccttcaagagactactcctggcagaccagttttgtctacctgcctgaccctggctcctcagaccacacatggtgggccagctctgcctacctgtgcttgaccctgggttctcagaccacacctgaaaggctatctctacctacctgtgcttgaacctgggttctcagaccacacgtgaaaggctatctctacctacctgtgcttgaacctgggttctcagaccacacctgaaaggctatctctacatacctgtgcttgaccctgggttctcagaccacacctgaaaggctatctctacctacctgagcttttcgctgggttctcagaccacacctagtgacatgggagggatagctacctgctccacacacatggggctcctggacaataccgtggctttagaaacaaacctagg

SEQ ID NO: 391349 - DNA, 802 bp, Homo sapiens
tcagacagtcttgctctatcacccaggctgtagtgcagtgatgcgatctcagctcactgcaacctccatctcccagaccacacgtgaaaggctatctctacctacctgtgcttgaacctgggttctcagaccacacctgaaaggctatctctacatacctgtgcttgaccctgggttctcagaccacacctgaaaggctatctctacctacctgagcttttcgctgggttctcagaccacacctagtgacccagactacctacctgtacttgatcctggctcttcagaccatacctggcaggcagctctacctacctgagtctgaccctggctcctcagaccatacctggtgggccagctttgcctacctgtgcttaccctggctcctcaaaccacacccagtgggccagctctacctacctgtagttgaccttggctccttaaaccacacctgaaagactatctctacctacctgtgtttgactctggctctttggagtacacctggcatgccagatctacctacctgagcctgatgttggctcttcagatcatacttggtgggccaagtctgcctacctgtgctcaatgctggctcctgggcttgtgcctggtggaccagcaccccctacctgcatgtgatgagggttcctgagcttgtaccttgtgggccagctctgcctacctctacttcacacctcagctgcttacacctcatccaacacacttggttcttcttacctgggcttgactatgactttttgggtctcatgaacacactcagctttgtgaagctgccctg

SEQ ID NO: 391350 - DNA, 635 bp, Homo sapiens
aaaccttgttcatgcgtaacaatgggtgggtttgccatcattattcctatgtctcgtccgtcgtcccttttatcattttcttttgaaattttgcatcctattccatatgaggaaataagaatttttaaaaataatgccatcatcaacaacagcaataaaaaatcattccagagtgtttactctatgccaagccccaggccaaactttatgtgctacatctcatttaattcacatagcaactctgtgaactagatgttgacatccatcccactctccagatgaagaaactgaggtttggaaaggtgaggtagttgtctcaacttcaccaccagtttgattttaacccaagactgtctgatgtctgggccaaagttctttgccaaaatgttatgatgccagccaaaacccatgtctttcttggaagagctctccaaattctagacagtttgggttgcaagatcaaaaccactataactgcctccatagagagcctacattagctctgtgcaggttgaaaggactctctgaagctcttgaaggtatctgtagaagtttttaagtagtaaacgtttccagcagagggaaactctggtttagcaaagaaggaactgacttcacatcccagttctgtctct

SEQ ID NO: 391351 - DNA, 256 bp, Homo sapiens
gtcacctcaccttgctgtgcttttccttataacactggatgcctcatgaatgcatgtctatttgagtattgctgtctcagcctcttagagtgtaagccttttgaggccagggagcctgcctgtcttactcattgccgtatctccagcacataggaggcagatgaagacgaactgcaggctcttagacaagtcttctctgttaagttataacttacgtaagtcatacatgaataatacatgaatgtgttctcaacat

SEQ ID NO: 391352 - DNA, 616 bp, Homo sapiens
gaactatgctacagagggcctttaggcaggtgaatctaacagtgctatatttagctattcattcagtcactcgactactgtatattgagcatctactatgagctaacattatgctaggtgctgggtgtaaaccttaaacatcatagacagaatccttttcctgaaagactttacaacccagtgtataggatagtggaaatgaagagagaggcaagagatgtggcacagctttcccctcaatttaactagtccctgtccttttaccctggggaactcattcagattctctttaaggaaactttactgttgtatctaaactactctcatttgtataactttaaaaaatcaaagcacatgtacatgtaattctctatttatgatacacatggcaaatgtggatatgtataaaatatgtattttggtccatcaattctaacctgctacttgagttcagagatgattcccaattaaaattctatatattctttatttaaaacaatggttctcatcccagtagtgtatctgaatcccctgggaaagttttcaaatgataattgctccacttaggaattcttacatccactcttgcatctttgggatggtatatccaagtctc

SEQ ID NO: 391353 - DNA, 405 bp, Homo sapiens
ccgtgtgggtcagccaccattcccgccaccccgggtccctgcgtcctttagttctcctggcccagggcctccaaccttccagctgtcccacaaaaccccttcttgcaagggctttccagggcctggggccagggctggaaggaggatgcttccgcttctgccagctgccttgtctgcccacctcctccccaagcccaggactcgggctcactggtcactggtttctttcattcccagcaccctgcccctctggccctcatatgtctggccctcagtgactggtgtttggtttttggcctgtgtgtaacaaactgtgtgtgacacttgtttcctgtttctccgccttcccctgcttcctcttgtgtccatctctttctgacccaggcctggttcctttccctcctc

SEQ ID NO: 391354 - DNA, 473 bp, Homo sapiens
ccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagat

SEQ ID NO: 391355 - DNA, 731 bp, Homo sapiens
tctcttttcattcatcttagttgagcttgtggctgccataaatataactcttcttttttgtaaagtggaacaacagtggaccctccagagttcacagattcaggtgggattagggaacatctactgaagccatcatttgttaaaatctgcttcctgctccttgatgcatctacctctcaaagccaacctcacctgttaaaaaggaactcaacagccattctgcatgcttggaaatagaaaccaagagaaattaacacaaaggacactttcctcctgtttagccagggctctaggcgttgttctgtcttctccaaccatgtacccccagtgaccatcttgtcacacagggaatattcaatgtttgtcgaaggagtgtgtgaaatcaactgtccattggggtgatatatggagagaactaaaaaaccgatgaaaaactccccaaagcatgtcatctctatagcatgccctttgagatcacatctcctactgctcaacaggcttcttcatctgctggaaggacatatacatgaggaagtttctgatactgcaactttagatcagaagtcctcttttaagttactgtttttatccaaaagaaaaatgccattttatcaattataaaaataggaaaatattcagttcaactaacagacagattataaagcagaaagtagaagtcttctatagacttcccctctgaagaagggcattcttcacaggctggtgtctat

SEQ ID NO: 391356 - DNA, 665 bp, Homo sapiens
ctaatatttattatggtggcaaagtaaacatgcacagcaagatcagtaatgggaaagataagtggagtctggagaaattcatttgcacgtttcctatgatctctctcctgtgataagtcacgtcgagttcgccttccttccagcagtgaaaatgcaactatgcctatgtgatgtttctgcccagatgagccagtttgaggctcagagtttagggatatttcgagggctggtcacataggcattttctacctagcaaccaccaaaattccagatgccagagggaaagcaggtgttcaccatagatcacattgtataaacagcctaagcccagcaaaatgaccttatcagttagtaatggagcacacattccgaaagccatgttcccggacaccagccaagaactaaccctgcaagcaggccctttgaaagatagcagcctcaagcctgctgttaactctttttttacacgagtctaactaacaaaccattttgaaaataaaaaaatcaaatgggaaataatggtccattaaataaatcattgcaattctttgctgatctctctcctctggtgtctaaacaatttgtctcacgtataaaaggcaaccacaaatttgcatggtcttgctgacacataatgtaaaagaatgagactgcttcatgtaatt

SEQ ID NO: 391357 - DNA, 316 bp, Homo sapiens
tcaggagtcagccagagttgtgcttcagtttcctcatctctccaggcttatttcaagggtcgagtgagaaggtcatgggcaggatgggcttagcatgtcactggccaggccacagtgaatacccatttacattaggggctgggagcatatgctctacatccacctgcttgaatcctggccctgtcgttttgcagtttcatgatgctggcaagttatcctcctctgcttcctcatctgtaacatggagatgacagttatagtgcccaccttgtgagttctgaagagtaaaagactttactcacataaagtgctcaga

SEQ ID NO: 391358 - DNA, 751 bp, Homo sapiens
agcggcggggattataggcgtgagcctctgtgcccggcccctgctacttcttttaagacgaaaagttctcaagaattctcttttcttggttttctgatttttcttcttccatcctccttgaatccactccactcaggtgtttgccctcatcactcaattgaaacagctcttatcaaggtcactgaggacctttgtactgctaaatccagtagcctattgtcagttctcagtttgggaaaagtggctgcattttacccagctggtcatttccttccccttgaaacactgtcttcactgcttctagaatacgatgctcacttagttttcttcctatctctctcattggttttatctcctttgcagattcctctttatctctctacctcaaatgttgaaaggcacgaaggcttagtccttgaaccaactctctttttatatatcacaaacttggtgaagtcattaatattagtggttgtaaatacagtgtgtatgctacatgtccagcttgactgcaatcttgaccttttttttttttgggctacatctccagtttgactggcagtcttgacttttcaataattaattctaatttgaattgaattgggttttggagacggagtctcgtgctgtcgcccaggctggagtgcagtggcgccatctcagctcactggaagctccaccttccgggttcacgccattctcctgcctcagccacccaggtagctgggattacaggtgcccaccaccatgc

SEQ ID NO: 391359 - DNA, 406 bp, Homo sapiens
attatttcatggtggtccttttccttctctgggcctatttctctctctcgctcatttatttatttacttttagacagagtcttgctccgtcgcccaggctggagtgcggtggcgcgatctcaattcactacaacctccgcctcccgggttcaagcgattctgatatctcagctacttaggaggctaaggcaggagaattgcttgaacccaggaggcgaggttgcagtgagccaagatcataccacagcactccagcctgggcgacagaacgagactctatctcaaaaaaatagaaaaaagaaagaaaaattctttctctaggccaggtgtggtggttcacacctgtaatccctagcactttgggaggctgagttgggaggatcactttagcccaggagatcgagac

SEQ ID NO: 391360 - DNA, 372 bp, Homo sapiens
tcagaatttattccttcctttaaatctaacaatatttgcttcatatatctgggtgctccaatgttgggtgcatattatatttacatttgttatctcctttactgaattaatatctttatcattatgtaatgaccttctttgtttctttttagttgttttttgtttttatgtttgtttgagacacagcctcactccctcggtttgtgtaagtacactctatgaaggtcacataaggttgaaataacctgaggatgcatttctcagaatgtatccctgtggttcagtgacatttgactgtaatgagtggcaaagcagtaaaccttggtctgtattattcgaactcctatatgctgactcacttacgtatttcag

SEQ ID NO: 391361 - DNA, 532 bp, Homo sapiens
atgtattgagctgattgcttaggtcaaggattattttcaaagatccaaatccaagaaacctaactttgcatatagacccattggtggcttctaagatttcttttcccatacattgcattacaatcccctaaacatgaaattacaagttcaagaagttttttcccaaaggtgtgtaggcattaagactttgactggttgtgaaggttaagtggactacacgtggaaaacttttttttttgctaactgaatttccgatcttgaaaatttactgctgagcgtggtggctcacaccttgattgattgattgattgattggagacagggtctcactctgttgccacccaggagtttgagatgtgcctgggcaacaaagggagaccccatctctacaaaaaataaaaaatcagccaggtagccaggctgaggtgggaggattgcttaagcccaggagtttgaggctgcagtaagctatgatcccaccactgcactccagcctgggcaacagagcaagaccctgtctccaagggggaga

SEQ ID NO: 391362 - DNA, 412 bp, Homo sapiens
taattcggacctgacatgctgtctcatttatcacaatattataatgttactgctgcttattttccataaataccacataatagtttctttctatttccctcaggtgtagaaccaaccaagggtatcacttgcagcaactacagtcactagtctcactggttttcaactagctgttaagcttctactcccagtctacataaaccacattcacagaaataggcaggtaagaacagtagtcatgaagatggggaaacataagcagtggggaaatcagaagatctgtttaacaaaaaattcttaatgtgttaacattaaagaccaaaagtatgtaaatcttttatttaagtgtgtattcaaagaaaaacttggatatccatgtagactctcattgattttgaattatctgacacag

SEQ ID NO: 391363 - DNA, 531 bp, Homo sapiens
cttctgatgtcctcataaatttggaggtccaatttccatttgaacaatgagtagatctaagctcagcaagcttaagcaaattatacaaggtcatagagctaggaaataatggaaatggaattcagacacattttgctgccccaaaaaaccacactcttaatcacatgcacccatttcccatataaaaatgctttaaaatcagaaagcctcatacacatgaaggaattctcacttaaccctcacaacataccaggggataataaggcaggtattttttcccaatttataaataaccagtggccagtcttagtgacatcgagctaataagtggcaaaactaggagttaagcctatttattatcttgttctctgagcagattcccttaactaaggaaagaagaaataaccttcaagttctgtctgaaagcagagtggtatttttttaatactagaagaaggtcatgccaccttatgagaatatagctctaccctccatgtatcttctgagtcaaattgacttattttatgtgga

SEQ ID NO: 391364 - DNA, 459 bp, Homo sapiens
  misc_feature (1)..(1): n is a, c, g, or t
  misc_feature (4)..(5): n is a, c, g, or t
  misc_feature (28)..(28): n is a, c, g, or t
  misc_feature (79)..(79): n is a, c, g, or t
  misc_feature (163)..(163): n is a, c, g, or t
  misc_feature (272)..(272): n is a, c, g, or t
ntcnngatcctctcctcactagcccagntctccccaaggtcagggctcatagagcagcaggagttgggttccgggacgngggatccggcttctctgggaatcttggattccaggaaggatcctggagatctcccactttatgaagcccaatctccactcactntgatggcgtctttagaccccactggaaaccagatacgacgccctcatcggccctggggaaaaaacaagagcaaagtatgagaggtggccatgaggtcagggaaactccngcagaattcagtcctttcctttgagaaggctcgacccgggaaccgaatcaaacagaagggacgggtcggtggacagggtctcgacctctgcgggtccaaattcggtctctaaaacctatgaaaggaactaccactgtattaaaaacagaagagaggaccttttcttcggggtcttggtagtctcact

SEQ ID NO: 391365 - DNA, 171 bp, Homo sapiens
tgctttaacaggtaaagtaaatgtgctaaccaggcacacgcacatgcctgattgacaagcatatgtcggctctcagaggaggttcgtttccacaggtttaaagaaaaataaagaggcctacagggaaaaaaccaaactgttctgtttggataatttaggaaaacctgagtg

SEQ ID NO: 391366 - DNA, 270 bp, Homo sapiens
aagtaaagtgacctgcttagtgcttaaacatcaaataactttgctaatctgcctctctgaaagtaaaacacactcacactcatcttccattcctgcttccactgatcccatcgaaagtgacatatccataggccaggcatggtggctcaggcctataatcccagcactttgggaggccgagaaactcttaatagcctaaatatccctaaggggagaacacggactagttacatgaattacagcatatctatcacagcatagcaaacagcc

SEQ ID NO: 391367 - DNA, 277 bp, Homo sapiens
cacacacacacatgtgcaagtgccccactgtatgtttcacagtcccaagcaaatgtttaagaagaaaatggaggcagagagagtttgcaggtattatgtgccaggctggtgccaagcattttacacatattgtttcatttaatcacagtaatcctataatgtggctattattgccctaggtcatagatgaggttcagacaagttaacaaacatcataaaagtcagtaatgcaactaactgtattcacaagtaatattaacgaataatacaaacattc

SEQ ID NO: 391368 - DNA, 285 bp, Homo sapiens
tttttctttacaccaatcctaataaagtaaacgtttgaatgggaatattagctatttttgaagatagatacaggacaatttattgtggagcatatacccattctggcctgtagggatgataattgctagcatgcatcaggaagcaagcttgtgaacaatccagtttttctagtacttgcttcatactagggagaaagtcatcagttactttggcatagaattttaggttcttcatctaatagaatttgattgtgaccattaatttttgtttatcttacgacttca

SEQ ID NO: 391369 - DNA, 308 bp, Homo sapiens
ggcatcaggggatgccatgaaatgaaggataccttcagtctgtaggctggtattgagtgttcactcacagagtggccccttccttctgccagtatttaccggatgcccacagtcattgtctgtaattctctcaacaccaaccctgtgaggtctgtttcctcattttgcagataaggaaaccggagctcagagaggtgtagtaacttgctgaagggcccccagctagttaatggcagttgccatggaggtccaggtccaccgcactcagcgcatgctgatggaattcccctctcctgcctctctggcac

SEQ ID NO: 391370 - DNA, 312 bp, Homo sapiens
taaaaaacagaacaatcaatacttgctatcaaaaaatagaagctacacacttaaataaaagatgttgcccatggagtccctaaaattgtcccgtgcgtcagcggctgggtgcacaccacactctgcgaaatggtgatgctaggcctctggccctttcctggaattcgcagcccctcatgaggagccctttggaatgagaggaaaaataagcatgtggacatgccctagccgaggagtgttcttttagtatctgccaattgagaaaatagacaacgtacaaagctactattcagaatgaattcaccttatgtt

SEQ ID NO: 391371 - DNA, 180 bp, Homo sapiens
aaaatgattttaatgtatgtccttatggttttctcatccaaatatgagcaaaattgtacaaatttaatattttaaatatattctaagcttacaaagtctgcatgagtttaccattgatcctctttagtattcctgaggtcatgcattatgtctcagttttgttttgtttttttaatattt

SEQ ID NO: 391372 - DNA, 330 bp, Homo sapiens
cacgccaccatccgtctgcttttccttcaacctttctggccttgtcttagtttcctttgaagactcatcctcctttaccttgtctttaagtgacagaattcctcaagacttcgtgcttggtcttttctcactctactcttgccctaggttggcctcatctttgaccatgtcttcaatactatctatatcctgttgagtcccaaacttgtttctctacctcaggcctctgttatgccccagccctgtgtatctccagttgtttatctcacatgcacctcaaactcaatttatgtccacaccggccctgtgcttcctcctcattcacccttc

SEQ ID NO: 391373 - DNA, 423 bp, Homo sapiens
agaaaaatatcccataaaaattgtgccccctagagggcgagggccacgggaagggggatcaggaaaacaagaatcagtctctaagctggtcctggagcagcatgacagatgtatctgagcccaagcaggagaggagccacaggcccaggctggcagagttgtgactactagaatctcgagtcactggggctcagggagccctaacttggtggcaggtgacaaatgtggcacaaaggagaaaggagtcttctccttccacatagaacacacttggcttcagtgctttggggggattcgtggaccacagagaagcttccgcatatttataggcactggggaccagcaggaagtggtggtgagacactttgaaaccctccactgcagacttcacccagggggcaaggcaggagagaatccctctgt

SEQ ID NO: 391374 - DNA, 142 bp, Homo sapiens
aagacgtggtgtattagaaaaaaaataggactaacacttgaaaactaatagaacaggaaagggaatatgaactgtgatgagggtgggatttaaatttaaagtaggtaaccagtgaaggtgacttttaaacaagaatttgaat

SEQ ID NO: 391375 - DNA, 429 bp, Homo sapiens
ttagtctggattcagtggctctgtgctatcctctgttattgttacccctcttctctttagaataatttggtagaaatttcttctctttgtcccctgggttgccccctctgatctgctcccagacttacgggatcaagacaacttgtcccaggtgggtgcagtgcctcacacatgtaatcccaggactttgaaagaccaaggctggtggattgcttgaatccaggagtttcagaccagcctggatgtggggaaaccccgtctctactaaaaatagaaaacattagctgggcatggtggcacatgcctgtaatcccagctcctcgggaggctgagtgggaggatcacctgatcctgggaggtcgaggctgcagtgagctgaggtcgcatcactgcactccagcctgggcaactggagtgagaccctgtctt

SEQ ID NO: 391376 - DNA, 326 bp, Homo sapiens
cacaagtgacttgttgactacaagatttactctcacagatatttccagagtaatatgaaatcccagccaagtatccgcagaaaaaagccagcggcatatgctccagcctcttttcctgagtgcagctccacagctacctctccatgcccagaaggacatcataaatcatttctaatttatgaggagcccagtcgtgtactacaccctgctaggtgctggtgtttgtcgtctacagactgtgagctcccttcttcagtgcatacagagactttttcagatcatccataggacagaaggttgagaatttttttccctaggactggccc

SEQ ID NO: 391377 - DNA, 415 bp, Homo sapiens
ctcccgaaaaatcatatctccacccaaacagaaatactctcatttagtctatgacattggactaatcaaaagcttactctcaaggataaatgtcttacaggtccttgctgctgcatttatgtcaaaaaataaactccttgagagaagaagccatgcgtgaatagatttttcccccttgttttctatttaattgtctaattgtttctagtatacatataaacaaattatgtgaatataattcccccctcaaattctactctgctattctaaacacttattttttccctgtaagaagccgcagctagtttaggaagtataatggttccaagctctgtaacaataaaagctagaaagcaacacatcaattttttaaaaagtacttgaaatattttagacaattacataaataaaggca

SEQ ID NO: 391378 - DNA, 282 bp, Homo sapiens
  misc_feature (28)..(28): n is a, c, g, or t
catccggacatggtggctggtgcttgtnatcccagcatggaggcttaggcagcacagcctgactgcttgggtcccagatcaccagagccagtcaccagccaggtctcctgatccctcctgattcctcaggcagctaagcccaggaccctcctccctctatgcctccctcaggcctggcccctctgactctgcctgcacctcacccccaggtgcacctcctggcccagacctatggggcctgggtccacctggacagggcccagctgatgaacgtggtgctgg

SEQ ID NO: 391379 - DNA, 1067 bp, Homo sapiens
aaggagatgaatagctgccaggaacattgtttgcacaagggcaggagctgccagatctgagaacacagcaaaatttttattttgtcaaaaatcttatattcagcttacaccattcatttcaggtgaacatacaacagtctgcatttcagtttagggaaatgtttacagtcgtctggttctctttattcttgggaacaaggttacctcacttggaacacataaccagtgccaagttgtccatccctaagcaatatcgcttcctcctactttctagaagttcttcaggttgtggaagacagacttttcagaattgtttgccctcattccctcctccaggaaatgcatgcctttgtataatctcttccccttgagagccagtaggctaacctaatgagttatgtttaaccagtagaatacagcaagaatgatagattacaagagattgtggcttctatcttgctagcggcctctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacgcagcagattgtaaataacacgcagataaaaccagacagaacagaaaaataaaatgactttaactctagaaagtttccccatgtaaaattttgaaaatgctactctgcctaaggtcaaactgtcatacatatatacgtatgaaaacacagaaaggtgtctggaagggtaataccaaattaaatctttatccaagaggaatgaaaaccagtattcacacaaaaacctatgcacaaaccttgtgaatatattaaaaaccagtgaattatgcactttaaaaaggtgaattatgtggtatatgaattatatc

SEQ ID NO: 391380 - DNA, 991 bp, Homo sapiens
  misc_feature (971)..(971): n is a, c, g, or t
aaggagatgaatagctgccaggaacattgtttgcacaagggcaggagctgccagatctgagaacacagcaaaatttttattttgtcaaaaatcttatattcagcttacaccattcatttcaggtgaacatacaacagtctgcatttcagtttagggaaatgtttacagtcgtctggttctctttattcttgggaacaaggttacctcacttggaacacataaccagtgccaagttgtccatccctaagcaatatcgcttcctcctactttctagaagttcttcaggttgtggaagacagacttttcagaattgtttgccctcattccctcctccaggaaatgcatgcctttgtataatctcttccccttgagagccagtaggctaacctaatgagttatgtttaaccagtagaatacagcaagaatgatagattacaagagattgtggcttctatcttgctagcggcctctctctgtcttctctgcttgcacactttgttgaagcaagctaccatcccagaggcaaggaacacaggccatcagtttagcagccttgaggaactaaattcttccaactaccacataagtttggaagtagattcttctccagtccagccttcagatgagaccccagccatgccaacatcttgattgcagccctgtgagagaccttgaaatagaaccatttctgatctcctgacccacagaaactgtgaaataaatatgtgttaaggtactaagtttgtagtaatttgttacgcagcagattgtaaataacacgcagataaaaccagacagaacagaaaaataaaatgactttaactctagaaagtttccccatgtaaaattttgaaaatgctactctgcctaaggtcaaactgtcatacatatatacgtatgaaaacacagaaaggtgtctggaagggtaataccaaattaaatctttatccaagaggatctacttcaaccgngatcctctagatcacctcga

SEQ ID NO: 391381 - DNA, 715 bp, Homo sapiens
cttcctgtctatgaatgtgacggctctacaggcccctacaagtggaatcaagcagtatctgtccttccgtgtctggtgtatttcatttagcataatgttctcaaggttcatccgtgtgataggaggtgtccttcccaaggctgaataatgttccatagtatgtgtgtgccatatttagctgatccccgctgacagacaagggggttcccacctttcagctactgggaacaatgctgctatcaacagggctgcatgagtacctgcttgagtccctgctttcaatgcttttgggcgtaaggcaacatacatttttttgttaccaactaaactttcttcctttccaatgtttattggaaagtgttttgggaattccaaggaggtgccgggctgactgtgtgagatgagtagttgtggtttacttcctgtaggacaagcgcgaccacccacacatgacggtactgtgaggggccagtagtacgaatgaatcccaactgggcggccctgcttccctgcctcaacccagggctgtgtgcttcccagcaggcactgccatctatccagccccacagtttcccagcactcagcacttctgatgcttggcctcaacctcgccaccactggagaagatgaaggtgcattctggtggcttccacaggtatgacactgtttcctgggacctgaagagaatgcactgtctacaacctgagctacaacc

SEQ ID NO: 391382 - DNA, 1383 bp, Homo sapiens
  misc_feature (3)..(3): n is a, c, g, or t
  misc_feature (6)..(6): n is a, c, g, or t
  misc_feature (12)..(13): n is a, c, g, or t
gcngcngcgcgnncggcagctgtcccgcctgccacaatgcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaattttgtt

SEQ ID NO: 391383 - DNA, 1165 bp, Homo sapiens
  misc_feature (3)..(3): n is a, c, g, or t
  misc_feature (6)..(6): n is a, c, g, or t
  misc_feature (12)..(13): n is a, c, g, or t
gcngcngcgcgnncggcagctgtcccgcctgccacaatgcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgacaaagaagacaaggaagacaaggaaggtgatccgggaggctggagagcttgtcaaggtcacagacccacggttttccgccccctagggtccaagctctttcctggacatctgcaggcaatgtcgacacgccctccagtgtctgtggcgggcaaaggatgtgtctccacccccagaccttccgatcctgtgctgaaagtgtccctcagcctgtt

SEQ ID NO: 391384 - DNA, 126 bp, Homo sapiens
ctgctggatcagaatggccagattaaaaactctagcgtccccagaaatatgtgtctcaaagtcaccagaaccccatgcctgaccttggatgtccagtaagaacaagacctgtaactggcccagtaa

SEQ ID NO: 391385 - DNA, 456 bp, Homo sapiens
ctcccaagggggaacgtgggtcaggagctgccacggggtctgcaagacgcttgctggcctcgaccaagtcaaggtggctgttccacgcggctgggtggacgccagctggtctctcatgaccctccccgtgacgcactcgcaaagtaactaccaaggctttctgctccattaacaccaaagctggccctgcaggggaaagaggagggagggaggacgtgggttttgtctagacagaggcactcacaaagccagatgatgcctgagcttccgccacgcaggaagagggtgagcagaggagggcagagaagacctggtgcgtccccctcagggtgccccccatggcagaagtcaccagcagaggccaagaacaatggccaatcccccttcttatccttaaaatcagggtaacaacctttcataggtttactgtgaagatgaaatgagatcacgaatgtg

SEQ ID NO: 391386 - DNA, 315 bp, Homo sapiens
caaataaataaataaataaaatcagttgaattcagtcttttttgaatgtgtatgtgttttacacacaaaacaaaaaagaggcaaatgaaccaaatccaactaaattgctttttacttctgtgtggccttccattgatttatccccccacttcttctgtggtcagcagtggctttttatagaaaaaaaagttcccaggtctctgtcatgcggttattgttttcacaacaatagaaaaaagtttccacccttgtattgtggaccacaagggacaccctctctcaagggatgtaccctgtttctagacttccttccat

SEQ ID NO: 391387 - DNA, 276 bp, Homo sapiens
cttactctcacctttctcagctttgccgctgttttctccttccccatctttcatctttgtttttccccctgactcttccctagtcaaaaacctgattttgggtcttgggttccatttccaccttgatttgctgtgcagccttaggcaagcgtctctacctctctgaacaatggggatgataagagcatgtgccctagaagggcattgcggggactgaatgatttaacgcttgggacagagtgcctgcatgtcattagtgcccacatgctgctggct

SEQ ID NO: 391388 - DNA, 432 bp, Homo sapiens
tttgctgaaaaatcttagaatataaaagtgaacatttggtataattaatatgttgtgctgcaggcataggaatgggatactgaatagaaactgagtgggaaactgaaaaatgacccaatgtaatattttaacgttaaagatgatgttctcaaagcagtgggtgaaaggagaggttactgaataaatgacatttgaacccttctttatttttttttaaagtttcctactaaacactatatagcaaaataaaataaattctaggtggattgaaaacttaagggtaggaacgagccctctagaaggattgaactagcacacggcaatgtttatgcactctcagaagggtcaggcctttccaagtgtcgtccccaaagtggagtcacgaggaaaggacacaagagtggctcagcctcccagaccaaggaaaacaga

SEQ ID NO: 391389 - DNA, 434 bp, Homo sapiens
  misc_feature (399)..(399): n is a, c, g, or t
  misc_feature (403)..(403): n is a, c, g, or t
ttaatatgaccatgatcattgacagaactgcatgtaaggaggtgcatgggctctatttttattaaagagcatattatccaggctgcattaatgtcttccttagctcagtcagactgattcatacagcttaattaaatacagcattctaaccaaataacttgaagattttacttttctgtgtttctttaaattgacctttaactctttttttttttttgggctttgggctttgagccttaattggcttcaccttttgttattggaattggttaagttagttggtgcctctccttgactgaagcttgaacaagtgcattgatttggtgtttgtggccattatctcaggttgtagccgtgagcatttttgttatttgtgcagcttcgccccttgagttgggnttcncgagcttcgaattacgaatctcttggctctt

SEQ ID NO: 391390 - DNA, 601 bp, Homo sapiens
gggctgaagagcttagcccagtgcctgatacaatctgtgtgcgtgaccaagggaccagccaagcttgcccagggtctggaatatcatgggaataccagcccagccacgtctgccttggtgacaaggtttcccagcctcctccttgccctctgagcagagctcctctgagcagtcattttgtcctcacacctaactggacaaaggaaacccagccgtccccaaagatccctttataatcctggctactgtccaggagggaccacttcacagaagaaagatcttggggtctgaaaaccactgccacttatgacctgtgtgacttgggcaagttactgaacctgtctgagcctctggtctgccagggataggaatactcacttcctgggctggttgtgaggatgatgggggatgatgtctgaacatggccacttgtagtagttgctattccctggcggccactccttctccttacagacgtcatacttactcttatttttgtttttattttttttgagacaaagtctctgttgcccaggctggagtgcagtggcgcaatctcagctcactgcaacctccacctcctgggttcaagcgattcttg

SEQ ID NO: 391391 - DNA, 558 bp, Homo sapiens
acatcaatctgtgtgcgtacagacactgcggtctggaatatcatgggaataccagcccagccacgtctgccttggtgacaaggtttcccagcctcctccttgccctctgagcagagctcctctgagcagtcattttgtcctcacacctaactggacaaaggaaacccagccgtccccaaagatccctttataatcctggctactgtccaggagggaccacttcacagaagaaagatcttggggtctgaaaaccactgccacttatgacctgtgtgacttgggcaagttactgaacctgtctgagcctctggtctgccagggataggaatactcacttcctgggctggttgtgaggatgatgggggatgatgtctgaacatggccacttgtagtagttgctattccctggcggccactccttctccttacagacgtcatacttactcttatttttgtttttattttttttgagacaaagtctctgttgcccaggctggagtgcagtggcgcaatctcagctcactgcaacctccacctcctgggttcaagcgattcttg

SEQ ID NO: 391392 - DNA, 341 bp, Homo sapiens
gactctagaggaaacccgacgcttatcgaagccaccctgagtgacgcccggcacaggagaggggacatccatctggcagcctttaatgttgagtctcagcttgaggcctggcccattggtgaagtgagaagccatcagtgactagccttcccctgacccacaaagctggagagagaaacatgtgagctgttgagaagagtggcaaagacttactgtgtttggtgtctgcttcagaaaaaaatgtgagattcctagtggaaacaggaatcctacatttcctgggcaggttgtttaaaggtgggtgggccatggatagttggcggtgagaggaacttcccttg

SEQ ID NO: 391393 - DNA, 486 bp, Homo sapiens
catcccattatagcttgtaaataggtgtcactttttctacttttaagaggaaaggtatcctgtaaaccaagcaatctattcacctgttagctagttatcactgaatcattttgagccccacagccaagattcctagatggcatttggagaaaagaccactcttgaatttccgaataggttgccctttattgttgaggccagacagtgtcttctgtggtcctttcttgaagcaaggttgcttacagacctactctcttggtcccctggagcagtgacttcctcagtcctttggtctttgcctccttaacagtaactggtggctttgccctggttaagagctcttgctgacttccacttgtccttccagtatgggcagtcaggtaactacatggaactggcttggcattgcatggaggagtgcggccaggggactgagagagcttgtcaccagagccttcctgtgctgtgtcaccccacactggtaac

SEQ ID NO: 391394 - DNA, 226 bp, Homo sapiens
aaaaaagagactttaccaaattcctaccttaactttgtcacagaagaatttacagctggttgctaaagataaatgaaattctgtataaatgacatgacgtattactatagatgtttgcgggccatgtcgtatctactataatgtagtgaagtaagtgcgatatatcatggctagttaatacagttgttattgagtttgtctcactgtgtttataatttccagtctg

SEQ ID NO: 391395 - DNA, 480 bp, Homo sapiens
tacattctctttttcctacgagtctctgaaataaaaagcaagttcactgcgtctaaagtaaaatgatggtacaggcattgtgtaagctttccatatccaaaaggaagacattttccagaaatcttcttatttttatctaggccccctcagcctggccttcactgtccatgtttctgtcaacattcttgtcacaaccatttaaccagtctctaagatggcccaaaaatgttctcatctgtctgtcttcttttgagccttccaaactcttccaaccgctaaccattacccagttccgaagccgcttccacatttttaggtatctttatagcaaagctccagtcctcatttgccatttttggtatgatttattttgaaaaagaggtttaattggctcatggttctgcagggtggacaggaagcacagtgcttctgcttctggggggtctcagaaatctttcaatcattgcacaatgcaatgaa

SEQ ID NO: 391396 - DNA, 347 bp, Homo sapiens
cttgaacccgggaggtagagcttggagtgagctatggtcctgtcactgcactccagcctgtgtgacagggcaagaccttttctttaataaataaatattttttaaaaaaatgaaagtgaggagcatatcaaagccaatgcctagtatgagacagaggctcaatatatgttactgtctctggattaaacaacttttccccactcccactttgcttcctttaattcaatgaaccaatatttattgagtgcctatgatgaaaaagaaatcacacaaaccaatgtaattgcaattaacaagtggtagaaatgaggtagtatttagtagattggtctggaaggaccaggtta

SEQ ID NO: 391397 - DNA, 354 bp, Homo sapiens
agatttggaaactgaggttgagaggggtggtgctggggtgaccaagcatcacagtttgctcaggacagcctcagtttacgcctgtggtcccatcataattcttaagggtgctctttccaatctcagaaatgtccctgctcggaggatcaatgatctggtctctgtggcaacaggcctgggccagatcccatcatcactgtcgctgttgacatgtcacccttggggacaagtcaggaaacgcatttccctttctctctatcttggggcagccatgcacacacactcacacacccctttcttcccagatcctgggggaacaggagaaggacaggctgtcccacggtccacccgctg

SEQ ID NO: 391398 - DNA, 503 bp, Homo sapiens
gtaggacaggcatccccatccctttgggttggccttgcagagggggatgccagtagggcccagctgcagtgagtgactcttcagtctcagactccactctggactcctccagactcatggatgcagaacctaacatcaacaggaggatgatctagttttggcactgccattcagagtccaagctagtcaccatccctcctcgggcctcagtttccccatctgagcaaaagaaagaaatgtgactagctctaaggcttctttgcgctgagggtctaaggaatcgaaggcaagttgcctccttcaaggctgggattctctgggtagaggtggtactgggcaactaccagagatgagtatatgaaatagaatagaaccattcttttttttttaaagagagatcgtgttttgctctgtcgcccagtctggagggcagtggtatgatcataactcactgcagccttgaactcctaggcttaagggatcctcctgcccaagcctcccaa

SEQ ID NO: 391399 - DNA, 415 bp, Homo sapiens
gctatgtagtgtacaatatgtagtaggcactccataaaagtgttaaataaatatatgcataaacataaagtggttcattaataactgttcaactctgaagagttacagcaaataaatgttttcaaaataaaatgctctaatctttcatcagtttatgctcagaaaagatggagatgtttacaagagctgtagtaacttgaactactcagaatttcttgatctaaaaatagtacatgctaggcttcctaccactgagcaagtctgacagctgttcattaggttggcacatattaataatatgctttaaagagatggttttgtcttctgttgaagttgaacagcaaactatgatttgctgtagatttttttgaaaaaatgtaaaaatttactaaagtaaaataacaagtgtttctgt

SEQ ID NO: 391400 - DNA, 336 bp, Homo sapiens
taggtagataggtaggtaggtagatagatagatagatagatagatagaaagaaagacagacaggtaagtaggtaggtagatagatagatagatagatagatagatagatagatagatagagtgggctacacatggatgtttttcttgagaggtatacttttgatttgactcaatagccttcatgctatgactcttgtgtagctcgcatcttaatgaggtaagtttaaccctcttacatgtcccactttacataggagtaactggtctgtctcagatgacacagccagtggcatagctgggatggcagtactaagtttgttgactgcctaagaagaa

SEQ ID NO: 391401 - DNA, 686 bp, Homo sapiens
catgacttattgctgatgatattaaccttgaactgttagattagttgtggtctgccaggttactatttgtctttcccatactgtattctttggaagtgaatcattatgtccagcccacactcaaggggaaggaaattaaatgccaccccctagagggagaagtatcaactaatttgtggaaatttattaaaaacactgtaataatttgggtaaaattatttgagcctatgcaactcttcagattctccttaaagtttcactcactaattttagcatgaatcagtggattgtgcctgtggcaattattacagtagtgttctaatgatgattttctgcttcccttatttattctacatttattatttggaatccctctataaagatttttcctttctcccctacttatttattcaacaatgtatatatataagtgtgtactcataaatatttaattatttgggttataatactcaacttatttattttgttggtcaccttgtcccagctttgcccattaggaactctttcatattggcttctgcgttctgttctatttttagtagactttatattttacagtagttttaggtttgcagcaaaattgagcagaaggtaccaagatttcccatattctcccttcctcccctccacatgcatagcctctcccattatcaatagccactgcc

SEQ ID NO: 391402 - DNA, 360 bp, Homo sapiens
tcttccagatcctcaatcatgtgccttatcaccctgcctttccctcaactctcacatggctccagctggttaggcctattattgtttgaccaagcacaagctggacaaaagcaagcttctagtcagcatggctttttgtagaaacagtaaaccagtcattctctgaatacaggtaattttttgtatactgttgtgagtatgtgtatttacaatcttttgtgcattttaaaacatttttgtccctctttaaaaaattgtaaatgaaagtgtccccacatttttgcctttttatttgtaatttatttcagtctattatttctgctttatgctactagctaatagtgaaagttcaaacaacct

SEQ ID NO: 391403 - DNA, 566 bp, Homo sapiens
gattagatgcgagctggtacccgatgagtaagatttggcattttaaagaggattcctctaagaaagattctgtggtttgcagaatgaaaagcattttcagtaagcagaaggctacagagacaggttagcgatttaacctccttgggttgctaactagagtaattcacatctgttacaactgcagcggaaacttctttaaaataaccaagatctcgaaacatagctgtagctgaccatgttctccgctaacaatgagctggaattcaatctgaaggtatactgaagctacttagttacctccactcaaggaaaactgtacagaaaattgctccaattaagttcatacctaccagtccaggacttgtatttgcttttttaaattatttatttatttattttggttttgtaaataacttaacgaactgaagccatataactctattttctctagtaggtaaactaaacaatggatatgtttttcttcaatataatagaaatcatgactaactacaagtaaatgactctgtaaacctcattttctttcttttcctatttttttttttttt

SEQ ID NO: 391404 - DNA, 222 bp, Homo sapiens
cataagggggtatcagtgttagaaaagacattttaactacagcacaggtggcaagtaataggaattcaatattactctaaaccatggtgaccattattattaggatgtgaatcaaaaataagtaaattattagggctgtttgctctgcctgttttctcttctgctgcagagcttttattaaatgacagttggtacctacagtggaaggtatgcaggattaag

SEQ ID NO: 391405 - DNA, 482 bp, Homo sapiens
gacttttgaattttcagttacacttcactgtaatgaatgcatgacagttatattttataataatataagcaaatttggagaatgcaaatttcaggatatatctcactgacataatggatctaatgtatgcaaatccaggaagaaaatccagtgttcccttccccatcttcttttgagcaaaagtctcaaaagaaaagatgttttaaagaactaagaaaagattggggaagaagatgggaaaaaattaaagcacaaataaaacacacaagtaatctttctgggggttgagctggagagagctaacagaccaggtttaggagtgtcgacctaaaggaaaaaactgaggcaaacttaatataagtgaagagtttatttggttgaagtttgaggactagaaccagagagcatatattcaacttgccccgaatatacactcccattagcagtgtacctgctgtaaagtacaagtaaatttttaaagg

SEQ ID NO: 391406 - DNA, 380 bp, Homo sapiens
caaaagaagcaagggttctgaagagaagaaaatatggtggggtgggatagagtgaggaaagatgatggtttcaaaaccttgaaagactttcatatggaaagaaggcaaaatttgttcagtacgtagctttagaggccaaaaatgccaaaaagaagttattatagggcagacacttttaactctaacccttctaagagttagaccctccaaatgcaatagtttaagtatcaatatccttgtgctgtaattgttccaaaagaggctaaaagaccatttattttagaaattggggcaagagtagagggattagattagttggcctcttgagtcctttctcattccaattctgattgtgtgatctaggaacttctcatttaaaa

SEQ ID NO: 391407 - DNA, 344 bp, Homo sapiens
cacgaagccccagcagcagggccggtgctgcagccagaacagtcgcattacgcttgctttctaataaaaggcctggcttcatttttaaattcaaataaaaatactgaaacatgttattatattagaaatattggccgggcgcagtggctcacgcctgtaatcccagcgctttgggaggccaaggcgggcagattacaaggtcaggagatcgagaccatcctggctaacacggtgaaacctcgtctctactaaaaatacaaaaaattagccagtggtggtggcgggtgcctgtagtcccagctactcgggaggctgaggcaggagaatggcatgaacccaggagg

SEQ ID NO: 391408 - DNA, 371 bp, Homo sapiens
ttaaaaacctactgctttagtgtttgcttctgaggaattgtgcataaaacaaattctttttctttaatgccatttgtttttgcttatccatacttcgcttgcctaattttagtgggccgtccgttgaagtggttgtccagagttagaaggatagtataatcatgggatttttcctatgggaattgaatccttgccttcacagttttattagcactttactgtagcttgcagacagaattttttaaacctgattctcttacaaattacatgaaaattcctaataatgtaattggttatgaaataaagaggtaggtacatcatatgtggggctccggtggatagtagtaactgaattcttgcattgttctttg

SEQ ID NO: 391409 - DNA, 399 bp, Homo sapiens
gctcacctgcccctccagctacttgtttggtgagaatgtgggtcacagctgcagctacattttctgcaaaatgccaatgaaataatgaaaggatctgatacctgcttcatggtagatgcaggcctgtgtggttgagacctcccaaggctgtcagcgtgagcacagagccgcctcctgaacagacgactgactttgttggaagtgtaaatgtagaagctttctaatagtttcctccctggtctgggcaccaaaaatcatatttaaaagttggtgtttgtgtaagaaaatatctttatttgggggaggtacactagatgaatgacaggatgctgagaggggacaggtggagcaagtgggaaacgttggcggtggttgaatcagggaatgggtacatgggag

SEQ ID NO: 391410 - DNA, 564 bp, Homo sapiens
gtcgaagcagcagccgcgttggggctggaagggactcagaccctgtgctctgaaacagggcagaaacctgttcaggaacttcaattcctgatgtagttatcacaaacattgtaccatttctgggtaaacgtaagcatccggttgctaatgcccataatccaaacgtgtcactgcagagtacacagaactgttagagaaataaaatacagaactttccagaagcagcaggagctggacatggtgctcatgtctatcacctcagcaactctggaggagtcacctgagcccaggtgttttttctttttgtttgtttttgagatgggtcttgctctattgcccagactggagctgcagtgagctgtgatcacgccactgcaccccagccttggcaacagagtgagaccctgtctcaaaaaaaccaaaaacaccacacacaactaaaggttataacagatgtgaaattggcgtaggtcattctggaagctgcacacattagcaggatgttttgtagagccatcttcacacaaaataaggtttgcttttttctgcatagagtaccttatt

SEQ ID NO: 391411 - DNA, 475 bp, Homo sapiens
gtcgaagcagcagccgcgttggggctggaagggactcagaccctgtgctctgaaacagggcagaaacctgttcaggaacttcaattcctgatgtagttatcacaaacattgtaccatttctgggtaaacgtaagcatccggttgctaatgcccataatccaaacgtgtcactgcagagtacacagaactgttagagaaataaaatacagaactttccagaagcagcaggagctggacatggtgctcatgtctatcacctcagcaactctggaggagtcacctgagcccaggtgttttttctttttgtttgtttttgagatgggtcttgctctattgcccagactggagtgcagtggcatgatcatagctcactgcggccttgaacctgggaggcagaggttgtggtgagccaagatcatgccaccacactccagcccggacaacagagcaagactccatctgaaaaaataataat

SEQ ID NO: 391412 - DNA, 352 bp, Homo sapiens
taaattcgcggccgcgtcgataagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 391413 - DNA, 3229 bp, Homo sapiens
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcgggtcgcgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaatttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 391414 - DNA, 2996 bp, Homo sapiens
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcgggtcgcgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaatttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 391415 - DNA, 2358 bp, Homo sapiens
tctgatagttagaataggtgtggacgtggccctgtatgctttttataaaccaaactctatctgaaatcccaacaaaaaaaatttaactccatatgtgttcctctgtgtctaatcttgtcaaccagtgcaagtgaccgacaaaattccagttatttatttccaaaatgttgggaaacagtataattggacaaagaaaaatgatacttctcttttttggctgttccaccaaatacaattcaaatgcttttggttttatttttttaccaattccaatttcaaaatgtctcaagggtgctataataaataaacttcaacactctttatgataacaatcgtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaatttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 391416 - DNA, 1256 bp, Homo sapiens
agctcctcctcatcatcacgtctagtgatgagctctccattctctacgtgcacatggatcataatatgctgcgtacgagttcctggacatgaccagagtgggctctcgtgtcctgcaagagatgcacgacgtggcctctcagtattgaacgaagatcctacattgggtttctagacatcttgtagttggatcaaatacgcatagtggattgtgttgcacacgtcagagcatctattctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaatttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 391417 - DNA, 1736 bp, Homo sapiens
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcgggtcgcgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggtaagttgaaaagagtatgtaaattaaaattctttgttttagttgacatttttaaaatcttaaaatattgtttaaacataatttgatatccacattgagtactaattttgctagttaatattgctggcagtaagttatttaatgtttttttaaattactttttgattgtccagaatttattttttataaaaaattaatttttgaataggtaataaattcacatggttcaaaaataaaatgtaaaagagtatacagtaaaaagtatcttatttctgtactctagctactcataggtaatatgtttattataagtttaaaaatcctcagtggagcaggtcaaaactcctgtgctgatcagtagtgggattgtgcctgtgaatagccactgcacttcagcttggacaacagagtgagaccattccaa

SEQ ID NO: 391418 - DNA, 523 bp, Homo sapiens
gaggtagaaggggcagtcaagattagagctggaagaaagtggaaaagaagttggaaaagaggagggcttttgtagggaagaatttaattttattatggttaaaattgaagtggcaatcaatagagataaggcatcatatcaaacattaatttgttaatatcttgcatttgtttactaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagc

SEQ ID NO: 391419 - DNA, 3153 bp, Homo sapiens
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcgggtcgcgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaagaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaatttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 391420 - DNA, 1817 bp, Homo sapiens
  misc_feature (1541)..(1541): n is a, c, g, or t
  misc_feature (1707)..(1707): n is a, c, g, or t
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcgggtcgcgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaatcacatcatgcatgatgtgattgttacaaaccttttttttggttttttcctcttctttgagactgggtctcggtctgccgcccaagctgnagttcagtggctcaattatgacttactgcagccttaacctcctgaggcccaggtgatcctaccacctcagcttcccaaatagctggtactacagggacacgccattacacccagccaatttttgtatattatgtagagatggggtttaccatatggcccaagctgncatatgggtcagctggcatatgcctggcctaaaccaaaccattttactagcacctttctgtcacttaatgatgagccatttgattcattgacttcactgaacaatcacat

SEQ ID NO: 391421 - DNA, 1394 bp, Homo sapiens
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcgggtcgcgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaattcacctattggggttccgttggtccaaaaggggtccctggattgggcgcagttccacacgaaaggaaacattgccatttgaataggttgtgccgtaagggatcctcccaaaggcttttggggtgccaca

SEQ ID NO: 391422 - DNA, 255 bp, Homo sapiens
ctctgctattttctaacattaaaattacaaatcaatcatcagattaaccatgtaaataaaagtcaaaagctacgaaaagcatactcattcaattcattgatctatacctttatatttctatgtaagaatcagcctgatcttttaaaatactgtaagaattcataaaattgaagtaattccatatgtagtgctgctctgttacttgtgatcttttactattctggtaataaccgataaagaagcagagcacatttg

SEQ ID NO: 391423 - DNA, 728 bp, Homo sapiens
ctgagagtaggcatttgtgctgactggcagtacccagagggccgacatctgttgcctgcaaggattgactaggaagctggacagctttcaagtacatctaacagtcatggcaagtctaatgctggtaaatggtgcagaatcaatcatgcagtccagttttgatacagttctaaaacctcatattcctgactaaggaagccagaggtaaagggacaatggtctctttcttcccctgaagttatttctgttagctggtaaaccagagaccacatgagaaagagaagaaacaggttttctcggaggtctttccggtgtgcaaggcctgcctagacaaaatatggttcaaactccgccaaaaatgttcatagaagacacatttgagatcatttgttttcttcctgcctttctgggaaaaaaagaattgctttgttttgtgaatatatgtacacatcaggtataaaaaaacacgtaggctttggtttgtattcaaagacttccagtgaaactgcgatagtccaaattgcaccgtgttgtttttcaaggaaacactcagtacagccacgcagcctgtgcagggcgacatcgtaggggcctggggtgggaaagggcaacaccaccgcacacccccaccccactggtgtctctgtccctcccacgggccctgcccgcctgactcagacaagggccagcctcagttctggctggaaagaagtcagccgttccctccc

SEQ ID NO: 391424 - DNA, 376 bp, Homo sapiens
gccaggctggtctccaacccctgacctcaggcgatccgcaagcttccacctctcaaagtgctgggattacaggtgtgagccactgagtctggcctgctttgggtttttaatattgttctatcaatttggattcccaatggtaaatttgcatagtttgcatagttagaagtactggttgttcactgtttctgtctggatagattagaatcataaaatgttagtgctgagaggacttagagatgatctggtgcagccccataatttttttacatcaagagactgagaatgtgagaacagtaatttcctgtttcccagcttccaccacagcaaactttaatttctgcactttggtcaagaaatgatcatcatatgacca

SEQ ID NO: 391425 - DNA, 500 bp, Homo sapiens
ctgagagtccagaaataaactcttacatttgtggccaatcgatttttggcaagagtgccaagatcattcaaaggggaaagaagagtctgttctacaaatagtatgagacaacatacatatgcaaaagaatgtgtttggacctctaccacacaccatatacaaaaattaactcagatggatgatatacctaaaggtaagagctaacactataaactcttgaaataaagcatgagtaagtcttcaagggttcggatcagaatatgggttttgagatctgacaccaaaagcacacgggacaaaagaaaaagtagataaactggtcttcatactacagtctaagggcttctacttttctcagctaagtttagtgtgagacactcagctgagtatggaaaaaggtagagaggtatgaggaaaggaaatataaaaggggtgatctgtagaacgaaagactaagaaacacaataagattgctagctagtgttcagagtccaaatcca

SEQ ID NO: 391426 - DNA, 490 bp, Homo sapiens
cagtgttgatccatttcccacacaaaggtggtgggggtgtggtctgggaggggagtcctgcagaggcccatggacaagtgcagccttggacccactgtgctctcagctccacccggtcccgtgggggcccaagacttgccctgtccttcagatgaacgaaaaacacaagcacaggcaagacttgaaacagcacaggactgtttgtaatccaaagtcaggaatgtgctatggacagtggcccatggcatgggtcatcctgagggtccaggggaggcaggctctgccaaaggaggctgcaggtaggatgtgcttgatacagtcttggtactagtatggtagtcactacccacatgccgctatgcaattttacctttttgacttgatattactaatcattacgcctgcttacttatttattttttgagacagaatctctctctgtcacccaggctggagtgcagtggtgccatcttggcacactgctacctct

SEQ ID NO: 391427 - DNA, 645 bp, Homo sapiens
tttcgtgttatatgagttttaccttaataaaaaacagtaacaattttaaaaatcagaaaagggggccgggcatgttggctcacgcctataatcccagcactttgggaggccgaggcgggtggattgcctgaggtcaggagttcaagaccagcctgaccaacatagtgaaaccccatctctactaaaaataaaagaattagctgggcatggtggtgggtgtctgtaatcccagctactcaggaggctgaaaggaggctgaagcaggagaatcgcttgaacccaggagacggaggttgcagtgagctgagattgtgccagtgcactccagcctgggcaacaaaagcgaaactccgtgtcaaaaaaaaaaaaaaaagaaaagaaaaggatttgaatagacgtttctccaaagaagatgtgtaaatggctaagcatattaaaagatattatcagcatcagtagtcattaggggaatgcaaatcaaaaacagaatgtgatactactttacacacactagggtatctacaataaaaaagacagatattaacagttggaggggatgtaaataatttgcaacccttatgcattgctggtggaatataaaacagggcagttgctgaggaggtcaatttgacacttcctcaaaaa

SEQ ID NO: 391428 - DNA, 358 bp, Homo sapiens
tttgggtatcaccatcaaacaagtatctgaagaaatctcaatgaatgttattattattattgcttatttatgaatctcatttcacaaacttgggaataaagtaaatattactgtctttactttcactaatgtatcctaatttctgtctccgagtcctattttgcttacctagtagaaaacttaagcttaggtctttctggcattctcaacctcaagagtgaatcacaattccttgggcttactgcaaagtatgaatataggacaaccttgtcttgagtcattgagcctacaggctgacttgaccataagaagtctgttgtttctatcctcatagcttctttaggtttactataacagc

SEQ ID NO: 391429 - DNA, 526 bp, Homo sapiens
ttaccaacgtgacagttgaggctgagagaggttcatgagcttgctcaaggccacgggtagtaataagaggcatggccttggtgccaagcgcctcccaaacaaacagccggggccgtggtcctgcctaaactctcacatccacggcaccacgctgggcccaggcaacagagataaggagagccctggctcttgggatggggtcgcgccgattcacatgctgtgccgcggagccccggcttccatccatgatgtgcccctgtggcgggataattgggaaacaacctttttctgattcccagagaactaatgagctgcaaaaagagattagacagggaagaattgctttcggggagaagccacttactcggctcgccttggtttttgctaacaacgtctccttaaactgctgtcaaatctttttctccctgtgtaggattcatcaatcttcgtatgcaaaagaacaccactgcactgcactgctaaaaattcacacaataaaatggactttaacttgcaaaaaaaaaaa

SEQ ID NO: 391430 - DNA, 178 bp, Homo sapiens
catccattctctgttatcacttatctatttgtctttctgttctgctttctgggagatttccctgagcttatggtttaacccttttaagaaaaagcatgggggaggggtatcatcatttttatttttagattctcttttccagttgttccttgttttattggcatctgaatgttgttca

SEQ ID NO: 391431 - DNA, 127 bp, Homo sapiens
tcaactctactttctcttctgcttttccttttattcttatttaataatttgtgaacaaaatttctttcttgaagtcaaaaatctatcatctttttatcaaacatgcccaatttgggttcattgatta

SEQ ID NO: 391432 - DNA, 366 bp, Homo sapiens
ttgcatggcagaaacagtactcttatttatagttttactacagtgtttaagtgaacagcctactataaggtaaataatgagggctaggattaggagtacaattaccagttttaaaagcaaagatttgcttctaaccctcaaagaatttagaatttagtttaaactgcagaaaaaacctcaagaacagctaacaacagtgtagtatagtttttcttttgaatcataatttttctctctccagtcatcatttttattaaaaacaaatcaagaaatggtttgtttataaaatgaattttactcttactgtacttggcctgattatttgcataaagtacagcaagagtaattatttttcatgtaagcttt

SEQ ID NO: 391433 - DNA, 513 bp, Homo sapiens
acacagcccaggacgctaggccttttctgggccgcccccgccgccccaggccgaaactccatccctttcccccaccctgccgagctcccgaagccctgtggcggctccgggcaagaactaagggcggcccctgcaagcgtacctgctccgccggctccgcggggccaacgaagcgtcccggaaggatccgggttcccggggccgctgcgcctccctgcggccggggcggagccgcgcaaggaaacgcgggcggggcgcgggtctggaatggcctggggaccagtccacctcgaggcagggtcaggcgccagggagtttggagacccggcagagtcaccccgcaaccgtcccgttgccttgggtcgggattcctttgctttgcagtctacagtagcgctccccgctcttgcttaaggtgcaccagacgcttcgcaaacgttctctcttttctttacaacccgtcaaggcagtagtctcccagttttacaaatgagctaaactgatacaggaaga

SEQ ID NO: 391434 - DNA, 718 bp, Homo sapiens
agacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggcggtgtggtgtagacagtggagcagctgggctgtgtggtgtagacagacagtggagcagctgggctgtgtggtgtagccagttgctcttaggctgtttttcctgttgcttcaggcctaaatttggacagtgtgtgactgtgctgaataatgtgggcagttgtaacacaacagcaagtatttgtgtatctaaacatagaaaaggtgatgtgttgtgctccgatgttacaatggctacaacatcattagcaataggaatatgtcagttctgttataattttatggaaccactgtagtatatgcagtctgtagtgtaccgaaacaccatcatgtgacacatgtatgtatacagtggatatacacaggtgatctgcaaatattatgccattttatatctgaaacttcagcatcctcaaattttggtagctgtgggaggtcctggaactaactcccatatataccaaaggatgactgtatataaaactagccta

SEQ ID NO: 391435 - DNA, 660 bp, Homo sapiens
agacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggcggtgtggtgtagacagtggagcagctgggctgtgtggtgtagacagacagtggagcagctgggctgtgtggtgtagccagttgctcttaggctgtttttcctgttgcttcaggcctaaatttggacagtgtgtgactgtgctgaataatgtgggcagttgtaacacaacagcaagtatttgtgtatctcaataggaatatgtcagttctgttataattttatggaaccactgtagtatatgcagtctgtagtgtaccgaaacaccatcatgtgacacatgtatgtatacagtggatatacacaggtgatctgcaaatattatgccattttatatctgaaacttcagcatcctcaaattttggtagctgtgggaggtcctggaactaactcccatatataccaaaggatgactgtatataaaactagccta

SEQ ID NO: 391436 - DNA, 380 bp, Homo sapiens
acatacccaaacaggctctagaagaaaaagaaaattgagagacctataacaagagactgaggcagtcatcaaaagccattaaataaaaagtccaggaccagctgggcacggtggctcacgcctgtaatcccagcattttgggaggccgaggcgggtggatcaggaggtcaggagatcgagaccatcctggctaacacggtaaaaccccatctctactaaaaatacaaaaaattagccaggcgtggtgatgagtgcctgtagtcccagctactcgggaggctgaggcaggagaatggtgtgaacctgggaggcggagcttgcagtgagccgagattgcgccactgcactccagcctgggcgacagagcaagactccgtctc

SEQ ID NO: 391437 - DNA, 712 bp, Homo sapiens
gtgggtggatcaactgggttcgagttcgaaaccagcctgaccaatatggagaaaccccgtctctactaaaaatacaaaattagccaggcgtggtggcacgtgcccgtaatcccagctacttgggaggctgaggttgtagtgagccaagatcgtgccattgcaatctagcctggacaacaagagcgaaactccatctcagaaaaacaaaaaaaaattatcctcttattctcagaattctgggaggaagggtgaggtgaggaggaggtgacactgatcaacaacagtgggcatttggatgagcttgggtgttcttcaagcctcctttcaaagcagtcatattttaaattctgataataacagaaactggttctttctttttaccttctttgaagagagctcataccagatctttcagcgtcactgtgtatctggcctcttgtgctttaaatttgagcctgacaaaaatccacggtgcttcagcataacaaaatgccgaatatgggacttctttgttcagtatgagaagacatgtttgagatatggacttaaccataggtgatactaagaacttatttcttcaggaatagtaatgcatggtgtttatgtttttttcaaaagttctcatcagttatagacaacacattgtagtagttataggcagaattacatagggaactcgaacccagtgtggggtcctctaggtcgcccgcga

SEQ ID NO: 391438 - DNA, 330 bp, Homo sapiens
tatattatgttaataaaatcatgtataagcaaaagacctatgaaagtataaaacagaccaatggattttagtataaaagtacaaaacgttcattgaggtgggttcagttttcccacaaaaactaacctttaagaaactaccacttatcaagttttggtataaggtataatatgaaagaagaaaatccataattatttgaaaaacacgacttaaatacttttcttttttcctactacatatctctattaggctgggttttcttcacaactaattgaatacaaaaacaaatatgagaatttagctgtaatctattaatccagacattacaga

SEQ ID NO: 391439 - DNA, 343 bp, Homo sapiens
ggacaagaggctctactgtggattcagtggcaaagaatgggaggggcagagtaagcaggtttaggattatcgggtttgaatgacttgattgagctgtagggtgtagagactgcctctactgtctggcaccaggggtaattagggcagctggatagtggtctggagtgtgagagctccctaaaggaggtggttggaggtgtaggttttggattggttgatctgtatatgaaaggtgcacgtgcagggtgagtcctctactatcactagaaattggctggtcccaggagaagtagtctctctagagacagcaatgccccagatgtcaaagcatcagaaaatacag

SEQ ID NO: 391440 - DNA, 700 bp, Homo sapiens
taagttatcacagggttggagaatgcagttgcattattagcttttaaaatgatgcaactgttgattaaagaaaattaaattgaactttgtaggttctttcatataagtaatccatttcttttttgtgtgaaaaggtgagctgttggctcaagctgaggccatctcatcctatatctaaaaaggatatctcaggaggtgaggagagggtggtgcctccttcatgggctgacaggattgtaggttggtatgccctctttgcagaacaagttggcagacagaacctaacagatctgaagatgtatgctcctagtacatagcaatttcacctttaattatgtgacttggacaaaatcttttacatatgcagaaagagatgttcattgcagcaatgtttgtcatgctggacatttgtaaataacctagatgccacttaatggggacatgaatgaagcaaaggtggtgtatttcgtgatagactactgtgcatcagtcagaaggaatacaagtaggtctctttttaatttgatactgcatgtgggttccctgcattaatatggacaggctcagaaacgatattgagtgatgaaaagaagatggagactggtatctacgttggatgttacttgtgtgaatttttactcaatgtaccaagcaacatggaatgtagaaatgtatcaagaggaagatacacacagagttt

SEQ ID NO: 391441 - DNA, 306 bp, Homo sapiens
gctgccaccctcctttggtgactttgcctctctctgcctctttactccctgcacagaggggcaaagaggcacatcctccagggaggcagggctaggtggaagttaaggtgatgggctttggggtccggcaggcctgagttcaattcccagctctgctgtgtgctgttatagctacgtggccttgggcaaatcccttaccactgtgagtattgctttattcacctgtgaaatgggagtaacacggtacctaccttctaggctgttgtgaagattaactgcaattctgcatggtgcttctgatagggt

SEQ ID NO: 391442 - DNA, 250 bp, Homo sapiens
ggtcgacgaaagggataatctcttctacacatggtattggaaaaactgaataacctcatgcaaacaatgaaattggatccttctcttacgctatacaaaatacatcaactccacatggaatacattttttctgtattttttctaggagttttaccgtttcacgtcttacatttaaaaatttattccatgtggagttgatgttttttgtatagcgtaagagaaggatccaatttcattgtttgcatgaggt

SEQ ID NO: 391443 - DNA, 777 bp, Homo sapiens
cgcggtggctcacgcctgtaatcccagcactttaggaggccgaggcgggtggatcacgaggtcaggagatcgagaccatcctggttaacacagggaaaccccgtctctactaaaaatacaaaaaattagccggccgtggtggtgggcgcctgtagtcccagctactcgggaggctgaggcaagagaatggagtgaacccgggaggcagagcttgcagtgagcggagatcgcgccactgcattccagcctggggacagagcgagactccatctcgaaaataaataaataaataaataaaaaataaaagatactaatcacctcaaaggaagctgctggagagctcctttaattcaactaatcaacaatattatgcaacggcttttttaaaaaacatgttcaaggatcatacattttactcagtcttttatataatttggcagggaatcaaggcatattaggaaattcacagaaaccataaacataaaaaaatgcataagtcctcagttcagtaaccacacaaatatttccgagaacacatccaaagccactttcccttctgcaaagctgttataaaatgtacttagcgtcgggcatggaggctcacgcctggcttacaggcgggcacctgtaatcccagctacttgggaggctgcagcagagaatcgcttgaagctgggaggtggaggttgcagtgagccgatattacaccctggccctccagcctgaatgaccaagtgagactctgtctaaaaaaaaataataataataaaataaata

SEQ ID NO: 391444 - DNA, 405 bp, Homo sapiens
gataactctgagagcaggcaggtgttccgagggccccagccagggtcagggccaggaggcctgggcagagccctcaccctatgccgatggccagcctgtgacctcacataagccaagaggcttcctgggccggatttctatagtaaccggccactgggtctgccggcatacgtcgcctgactttctgctgttctattctttggcagaacacccttcccctgcctgctggctgcctggaactgaatgaagccaccgtgatttcagggagagatcccggctcctgccctccccaccagcttcagcagaactctgccctcttgggtcatgcatttcctttccttacttcaccagctctggttgtacacatccgagactccccaggactctaccaagggcctgatagag

SEQ ID NO: 391445 - DNA, 106 bp, Homo sapiens
aaacgctgaataaaaccaagcaatgacatttctggtatgtcactccaagtagcttaattttaatggataaaatgtgctcattcatatacccatccattcattcatg

SEQ ID NO: 391446 - DNA, 788 bp, Homo sapiens
tacaggacttatataccaaaaactataaaacactgacgaaagtaatgaaggaagacctaaataagtagacatatcatattcatggattaaaagactcaagatgatgtcagttttccccaaattgatatacagatttaatgcaatttctgtgaaaatcccagcaagattttttttgtagataagatggttctaagatttatatggaaaggcaaagaaactaaaatagctaaagcaatttatttattattattattatttttttttgagatggagttttacactccagcctgtgtgacagagcgagactccaatcaaaaaaaacaaaacggaaaacggtaattatccctgtgaagactttccttaaaagaggggtctacaagaagggaattgttggccggcttgggtgtccccaaagtgcgggaataacgggcgtgacccaatgtggcccggccaattgatgggagaattctcaggaaaactggacggttaaagcaatgtgcaggatatttcccacgttacggaaggacacgaattgttaatctagaaatcgtgtaccccagctggacaatatttgtccgggaatgaacgcaatctggacaattcttttgtgatgatcggggacgggatcaccacttgtgggcccccaggaggagggcggggaaaacatcagtaggggacatcggcctaagtaagcgaaattggggccgctcggaaatggcagagaggaccccaggggaaatggcttacggaggaagtcaggtagcgagtgttaaacccgaacgggggca

SEQ ID NO: 391447 - DNA, 292 bp, Homo sapiens
aggtgggggggggggcaatagggagccattgaagatgcttcagttgtggagagggggccaggatatgacttgtgttttaagatccatccagctgtcaggtggataatggattcatcaaagggctgcaggaggcagggaagagggacagacgaggacttagatgaggatggtgtaggggcggggtggccagcagtagacaggggcccaccgtccagtagaactttctgcagtggaggaaatgccgtgcacctgccccaatcactgcattagccatgagccccgggcggcagtt

SEQ ID NO: 391448 - DNA, 420 bp, Homo sapiens
gctacacagtggtagaaaattagtacaagatgaaaaagatttaaaaggaaatgacagatatacatatataggaaacaggcaaggaagaccctgtacacatgggtacacgtgcatgcgcacacacacacagatatattagttcctaaagaaataaaatcagccaggcgcggtggctcacgcctgtaatcccagcactttgggaggctgagacaggtggatcacctgaggtcaggagttcaagaccagcctcaacatggagaaaccctgtctctactaaaaacacaaaattagctgggcgtggtggtgcaggcctgtaatcccagctactcaggaggctgaggcaggagacttgcttgaacctgggaggcggaggttgcagtgagccgagatcgtgccattgcactccatcctgggcaacaa

SEQ ID NO: 391449 - DNA, 272 bp, Homo sapiens
tccatttcagatttccatttcaccctatatgttggttataatctttgcgatacgattgcttatcctagattagaaatgcataagtagaatactacccttatatctaggtgaagtgactgcctttatgatgtggtattaggaatccttaaaaagacaacacgccttctcgttaacatgtagccctttgccatggtatttccattttagtaagctttccttagtaaagtctgctttcaggtaccattcaatgagataagtattaacggtcgacg

SEQ ID NO: 391450 - DNA, 122 bp, Homo sapiens
agtggagagtgagtggtagaaggtagaaggcagaaaacaggaagctgttatagttttccatttattttttgagacagggtcttgctctgttgcccaggctatagtgcagtggtgcaatctta

SEQ ID NO: 391451 - DNA, 355 bp, Homo sapiens
tctagaggatcctacgagtgtatgtggcggagtgatattggcggagtgaatggctggcggagtagatagctggcggagtggatgctggcggagtgaatagtcacacttgcaattccatcactttgggaagctgaggtgggaggattgcttgaacccaggaattgaagatgggcctggacatggtgaaatcgccatctctacccaaaaaaaacacagaaatgaccggtgtgatggcgtgtgtctgtagtcccagctactcgggaggctgaggtaggaggattgcttgagcacaggaggtcaaggctgtagtgagccatgatcacactactacactccagcctgggtggcagagtga

SEQ ID NO: 391452 - DNA, 432 bp, Homo sapiens
ccacccttcttcagtaagcgcttacctaccccgaaaccaccccatacccctcttggtagttttccttggtagcactacagttggacttcactagcaccccccaaggtttcatctcctcttcctctactctgatgtcttgacgttttgactcttttgtgcctagtttaactctcacactattttaagataaagctggtctttctgtgtcttggctctaagccccaccaggtctatttttcaaatgcaattcatcaaagtcctggcccactctccatgtgtggcttgccctcgctcctggactgagatgctcctagaagtagctcctttccaggaccctgaaggttggatacaattttacttgacaataaggggaaggaaaatattctatggagaagatatgtcacagccaattagccttccttggactaaaag

SEQ ID NO: 391453 - DNA, 498 bp, Homo sapiens
ttaagatagtacgtcttatgttatgttaccacgatttaaaaattggaaaaaagttggcgtgctgaagccctggcctgcagagaggggcgagcagtccccagagattctcgccagctgcttcacgtccgagaatccaggagcccagaggctgagcaaggcctcagacagcagagccctgcattcccagtttctgggagttgagcccaagtgagccctcctgaaatggtgcctaggagagagcagcagaccccgcagcaatgtcctccctcaatggcctttcacagccatcggggacaccaggttgaaggcacagggactgggaggcaccagagaagcctcagctacccagggtggtgtgagctgggcattgggagccagggcaggcagcacgtgcttctccatggggaggtgacaggcagccttttggggagatgactccagtgaaatgcacatgatgccagacaggccctgctgggtgccctgagcccacacacagga

SEQ ID NO: 391454 - DNA, 621 bp, Homo sapiens
ataaataggatattaaattcaactggggtattagattataaattagttctgtaataggcgtcataatgttatttaggttttcagtttacacagaccttgtagcaactccccagagctatgctacagaattagaagtagatggaagttgatgtaagaaaattggtttttgtaatatgctgatgccagtagagttgtgctgtgtgtaagtaaacgtatttaaatagcacgctcctacttacttgattgtacagacaaaagattgataataatttcaaatgattgatttgttggtgctgatattggccatatgtgaaactaaaatatttctttccaaaattgaagcagtacttcccgtgtgagggctaagaatccgggttgtagaaagcataagactatcctctgaatagatgtttctttttcatctgattggtgtaacagtggtatcacaaatatttcttagcggcaaagtttcttggtccttttagttatatttcacatggaggaagatactctacccaggaaccctgtgtggttattgaagtcattagcaaggagggtataaccttagtgaatcattacccatgggacacaaatggaaaacatgcacatttaatttaaaaa

SEQ ID NO: 391455 - DNA, 380 bp, Homo sapiens
gtggaggtgactggatttctgacccgatttacagagagatgcctgtgtcccagcaccatcactcagagaaaaacgtggaagccaatttgcacaggcatgggaagttttccatcaaccaagatagcagaaacacaaatgagaatagatgagcgcacccaatgctaggaagcagagagtctggggcaaaattccaaaaagccgagccacttacagaaaagtttcacaaggtggggaggtattgcaacaccgagaggatgatttggattcttacgtgcagccgttggatgccagaaagatagagaagatgaagatatggtcatacatttctgtcttgagaagaagatctggtagtaatacttcagggattttgtagtcttccc

SEQ ID NO: 391456 - DNA, 362 bp, Homo sapiens
ccagcactttgggaggctgaggcgggcggatcatgaggtcagaagtttgagaccagcctgaccaacatggtgaaaccccgtctgtactaaaaatacaaaaattagccaggcgtggtggtgtgcacttgtaatcccagctactcaggaggctgaggcagaagaatcgcttgaacccaggaggcagaggttgcagtgagtcgagatggtgcctctgcactccagcctgggtgacagagcgagactctgtctcaaaaacaataataattttgtattctataacataaacagcatttggaaccgcgtctccagtaattttcatctctacacaggccccgaatactcagtgcatactccacgtcagg

SEQ ID NO: 391457 - DNA, 560 bp, Homo sapiens
agtattgctctgtggcccaggctggagtgcagtggcgcaatctcagctcactgcaacctcaatgcttttcttctcatatagcacttaagtccttggatgatggacctacagctcttaagaatttccgtgtgtgtgtctgtgtgtgtgtggttagcagaaatggaggtttcaaatgaaaacactggaaaaaaatgatttctcatctatccaattataataccaaaacagcaacagcagcagcagccaatgctgtcttaggtacccaggaaggtgaactagtgaaaatcatttgtactcaggagcactagatggcagcctgttatattcatcttacatattgaatctgtgcaaagtcagctatcagtctgattgccctatcccacaaattgcatcccaggagatgattagatgcaataggtgaaagttttcatgttcctcagtggcattcagtgcatgaacaaccattgtccacctaattcctctgcatctacagcaagaaatagaatttttgtggagacttaacatgctgtgtcttacttacatatgtatgcaaaaaaaaa

SEQ ID NO: 391458 - DNA, 106 bp, Homo sapiens
ggtcttatgatccggcggatcctcctggggaggccgggccggggagagggcgcgggcgccgagtggcgggggcagcgggcgggcgcggcgaccggggccggggcgg

SEQ ID NO: 391459 - DNA, 461 bp, Homo sapiens
acctctacagctacccattgttaatacgaagagaaaggcacaaagtgacaaaggagaataattccctctgcaagtcacctaagtgaatattcaactgaagtgtataggagacagaggtcttaaacatccctgatgaacagggctggcacagaaacattatttgttctcacacagcaatatgaaaggtcacaaactatttgacatatttgcacaagagtggtcatgagagatcaggacgatgtgacagtttcgttcaacacacataactgaacagacattagctgaagccccaccaggagccaggtgctgtgtggggtatggaaggtggggaagacagggctcctgcccttaatgagctccagaccccaaactacctgatgagagcaacctggagagtccattttctatcttctgtgcgcctccattcagcatgctaacaacctcggcaacagacaaataaa

SEQ ID NO: 391460 - DNA, 830 bp, Homo sapiens
ttgcaagcggggaaccttgagctacctacgccagcgttctggattattttccaaatttggttcctgataatctgagaaagctatgcgctcagtaagagcagggaccttgttttatcaaactttgatctttcattaagcacacagtgggcattcaacaaacttgtgtaaacttggaatcagatttagcccaggccggtgcggtggctccttcctgtaatcccagcactttgggaagcctaggagggcggatcgcttgaactcaggtgttcgagaccagcctgagcaacatagcgaggctccgtctctacaaaaaatacaaacactagccggccctgtggtgcagacctgtagtcccagctactgaagaggctgaggtgggaggatcccctgagcccaggcggtcgaggctgcagtgagctgagatcgggcctctccattccagcccgggcgacaaaaaatccagctaagtaaaaattggcaagatcctgtgacaagatcctgtgacaagatcctgtgatcaagacaaagttttgcccccaaaggacttgaggctatctgggaattccatgtttgacagaagcgctgacagcataaccaagcaaacaagaaggtattcagggacgctgaaacggatcttcaaagaagactcagtgggtgatttttaatttctgtgtagtattatagagcttaatgcagaacataccaaaaccttggagaggtaatgatagggtcatgcatttcataaggcagagtaatgccctgcaacaacaaaataaagtcaaagagttctacactgagccatgaaccactaaatggggaataccaacaaa

SEQ ID NO: 391461 - DNA, 544 bp, Homo sapiens
gagtatattaggacttactaagggaacagagagaaaggtacaaaaaaggatatcatggtactggctgtgagactctcggggactactaaaaactgcggcggtccatacatgttctggtggacgtaccaggagaaaacagagcaggaacagagcaggtacagagaggcaaaaaggacaataatatatagttaatatgttatgctttaaaaaatgtctgagtcaagtataagatttttgttatatctatttatataacagatatttatattagtttgctggcattatcataagaaagtaccacagactcgatggtttaaacaagggaaatttctcttcccacagttgtggaggctggaagttcaagaccaaggcagaggcaggattagttctctgtccagcagtcacttcggccagagctgaagagttgccccgtatctgttccatgtctcctttaagagctctgggtgactaagggcatgaagctttactggaatttcttatactagcacatgcgtcaatagtttcaaggacttgaaaaatactt

SEQ ID NO: 391462 - DNA, 237 bp, Homo sapiens
gtgagtggggctcctgagggctcgaagtgggtggaggaagccattctagaattgaacagttgctacaggtcacacagatgatgaaacactgcctacaggccagcttcagctcacacaagcccactgtaaaccgtgcagacacagggtttatggccacaattttttttttttttttttaagatgggatcttgctatgtggctcaggctggtcttgaactcctgggctcaagagatcct

SEQ ID NO: 391463 - DNA, 549 bp, Homo sapiens
gcagagaactcaatcccaggtactaatgaccttgctttggcttgcaagactaagcctgaggcctgtggacttaagagggttactgggtacccagacaggcaaatgcctgtttgattggatggctaaattgtgaagaaagcaaagcttacctgtgcaatgtgtccatgccttcattcctactttctgaatcaactgtgcctgttattgttctgcccaactgttaagatgttccacctgtgcctgctctttggcgcagtactccaggctatagaccaacatttctcaaacctggctgcacattagagtcatctggggatcttttaaaaacccagctgccttggctgcacatctgatcattacgtcagactcttgtagggaggagtatagacatcagcattgattaaaactcctgagattaattccaatgtggcagttcagggatttgaggaacagctggtctacaccagtttcctcttgaagtatggtctgtaagtcacaggctgcagaatctccttggatgtttgtgggaaatgcagattgctaggttca

SEQ ID NO: 391464 - DNA, 154 bp, Homo sapiens
ttggaagggagcctctgctgcttgcacttgcaagaaggtggggcccaactgcccctcactacacagaactacagcttcccagcaacagaggccagacaagctgcagagctgcctgctcaggactggtgagagaggctctgccctgagcccattt

SEQ ID NO: 391465 - DNA, 227 bp, Homo sapiens
catctgctgaaataaattagatcaaaataagattgaagagatcttcaagtgctgcaacacctaacaaactgattttattatttagataacaggaaaaagtgaaaagaactgaagtttaagaaaattaaatttgtgtacttagtgaaagatcagaagtctcagtggagaaaaattctaatttgtattacctacaaaagagggagaaggtcacctgaaaaattatacag

SEQ ID NO: 391466 - DNA, 293 bp, Homo sapiens
tgcccctccttgaaaaaaacagataatgtacatttataagttttatgttaaaataagttattgaaggtatgtatatttctttttattttaacaatgtatgggttaactggccttttggttattccttcagataaaacagactttactagattaagtcctcagatattgatgtgaataatcttttcactttttttttttctaattaaggctgctaatctaatacagaagaaatacttgaggctgggcatggttgctcatgcctgtaatcccagcactttgggaggcgaaggtga

SEQ ID NO: 391467 - DNA, 771 bp, Homo sapiens
cactccagcctgggcaacagagcgaataataatactactactaataataattgagcaggattaagagattaggatttggaggatgagtcacaattttaaataatgtggtcagggtaggcttcttgaaaagctgcatttgaaaaatgacttgcaagaaggtagagtttcatctttgatgagacaaatcctttgaaaacccattttgcatggaacccaccagatggaggcatgttaaaaccttatcctaggcgcagtgcctcacgcctataatcccagcactttgcgaggctgaggccagtggattgctcgagcctaggagttcgagaccagcctgggaaacatggtgaaatcccatctctacaaaaaatacaaaataaaattagctgggtgtggtggcccgcacctgtagtcccagctactcaggaggctggggtgggaggatcctttgagcccaggaagtgaaggctgcagtgagctgtgattgcaccactgcactcaagcctgggtgacagggcaagacactgtctccaaaaaaaaaattaaaaaaaaaaacaaaaccaaaacaaaacacccacacccacacaactccacaaccttatcctagaacacttcccctatgtaagtcttcctcatcttaggaaggaggttctcagagtgcatcagctggtgttgctgatgaaggaattagctcacctggaaaccgaccttgtcctttctgaaagaaccatgccaaattttggggtgccttgtcagggcaatcactggaagtgt

SEQ ID NO: 391468 - DNA, 373 bp, Homo sapiens
gggaagggcatggtgatttgctctgatttacatattttaacaaccctctatatacacaaaataactaaaagcaaggtctcaaaagaggttatctgtacactgattcacagtagccaagaggtggatacaacccaagtgtccatcaagagatgaatggataggctgggtgaagtggctcatgtctgtaatcccagcactttgggaggccgaggtgagtggatcgcttgaggtcaggagtttgagaccagcctggccaacatggtgaaaccccatctctagtaaaaatacaaaaactagccaggcgtggtggcaggtgcctgtagtcccagctattcaggaggctgaggaaggaggatcacttgaacctgggagg

SEQ ID NO: 391469 - DNA, 167 bp, Homo sapiens
tccatcttcacagtctttgaactctcacacatagcataatgagtcagtataccctatttatgagcctgagatgtgtttattttctaaaatattatatgttcatttcctgaagaaaatagaaaatgctttatctagaaacatcttgttgcctagtgtgcctaatattt

SEQ ID NO: 391470 - DNA, 279 bp, Homo sapiens
tcaggaccctaacaactcactttctctttttttttccccacaatgcaacattcaatagtggtttgggctcagtggacatacttccagattgtatgaaactgcaattcttgagctatagttttggggtgttggagaagatggggagcaagttgtctttagtttggtcggtcacctaatagaagaaacagatggctccaggatgattctctggaaaggtccagggcagagtggagtggttgaggcagcccactccccaggagccctgtggtctgactgagg

SEQ ID NO: 391471 - DNA, 349 bp, Homo sapiens
taaacagggtgaaaccaagacgtgcatgttaatttaagatatgataaaaggttaattcggaaaacataggaggtggagaaagatattgggttctacatatcatgacatcaaaagggaatgagagaaaaaaaaggcagaggctaattatcccttttgagaaagctttataaaagaccaaagaaaagggtatttaacaagaccctaaaatttctatcaggaaaaaaaaagcaaacgtggcaggatggggacagggtatcactgagaatgaggctttccgtcccagtaacagcaaagacttgctcagttgctgaacagcttcaatatagtttccatacccatagcagcaatt

SEQ ID NO: 391472 - DNA, 659 bp, Homo sapiens
ataacaaacctagtggttttcatttgaaggcagtggtttttaaacaaaagtattttcacaaaaggaatgagaacatctcagtattatatatttgatacaattcccaaataaattgtcacaataaaacaaggttgcttatgcagaacccttgaaatacaatgtatgtaaaaatatttttactactgtgctcaagaatagagattttgaggacaattcttacatatttaagaagcaaaaactttagttaatactcagactttattcaacatcagaaaatatgcaatgaagagaaaatctacaatttaaatcagcttgcagatacatttacttctggatcacaacttactcagcattagaaaattcacactggctgggcgtggtgactcaccctgtaatcctaacactttggaagtctgagggcaggaagaggccttgagtccaggaattccagaccagcgtgggcaacatagcgagacactatctctacaaaaaatttaaaaaattagccaggtgtggtggcgcacacttgtcccagctactcaggaggctaaggtggcagggtcctttgagaccagaacgtcaagcctgcagtgagccacgtttggccaccgcactccagcctcagcaacaaaatgagaccctgtctcaaaaaaaaaaga

SEQ ID NO: 391473 - DNA, 1123 bp, Homo sapiens
ataacaaacctagtggttttcatttgaaggcagtggtttttaaacaaaagtattttcacaaaaggaatgagaacatctcagtattatatatttgatacaattcccaaataaattgtcacaataaaacaaggttgcttatgcagaacccttgaaatacaatgtatgtaaaaatatttttactactgtgctcaagaatagagattttgaggacaattcttacatatttaagaagcaaaaactttagttaatactcagactttattcaacatcagaaaatatgcaatgaagagaaaatctacaatttaaatcagcttgcagatacatttacttctggatcacaacttactcagcattagaaaattcacactggctgggcgtggtgactcaccctgtaatcctaacactttggaagtctgagggcaggaagaggccttgagtccaggaattccagaccagcgtgggcaacatagcgagacactatctctacaaaaaatttaaaaaattagccaggtgtggtggcgcacacttgtcccagctactcaggaggctaaggtggcagggtcctttgagaccagggtcctttgagccgaggctatagtatgccatgatcacgcctctaaatagacactgcattccaaactaggcaacataatggcatcctgtctctaaaataaataaataaataagaaaatatttggctgggcgcagtggctcacacctgtaaccccagcactttggaaggctgaggcaggcggatcacctgaggtcaggagttcgagaccagcctggccaacatatagtgaaaccccgactctactaaaaatacaaaaaaattagctgggcatggtggcgtgtgcctgtaatcccagccactcgggaggctgaggcaggagaattacctgaacccacgaggtggaggttgcagtgagccaagatcacgccgctgcactctagcctgggcaacaagagccaataactccatctcaaaaaaaaaaaaaattggctacatgcagtgtttttatcacattaaccggtattatggtgaagttaccttttgaaaagtcatctggcgaaaacaactgttaacatcagatgacagtgactttgacaaagcattatacta

SEQ ID NO: 391474 - DNA, 612 bp, Homo sapiens
gtggagctcctactacaacagaaatgctgcaagggcctgctctgagatgtgctgatgggtcactatggtatttagaaaaaggagagtggatgctcaagattccgtgaatgggtctctgacatgcgttctgtggaaagataataagaataatgataccaacatggctccagtctttatgcatctcaggtatacctcactgtgtctttaccatcgccccctgtgaggcaggtattattatttgtcccaagattcagagaggtaaaaggagcttgcataggtagacacggatgagttgggaactgaactcagacaaatttcatttactcagacagaaatactgttggagtggaagaggaccattcatcagaatatcacatttggagagaactattcccaaagaacatctatcttacttaactttgattctaggacctccaagtagttgaaaaatatggtttccaggatggctggacccatcaatataccatgtgcaagcctggtcttattctccagtccccgtctcactacacctccacctctaggtccaagccactattctttttcacctggcaattgcaccagcctcttcactgggctccctgttgccaccct

SEQ ID NO: 391475 - DNA, 811 bp, Homo sapiens
gccccggggctcaggggcagcccaggactctccctcgcccggctcacggccctgcctggggggcgcctccgggagcagatcacgagccctggggctcagccctcaggcgcgtctagctcggcggtcaccccagtgccgggaggaccctgaagacgcgccccaggcggccctactcagagcctcctcccaaggcccaggaatgcggcgctgtcggaggtgtgcgcggtggccacaccgctgtccgggtccccaaagcgggccccgctcccacttctcgccttggccccgaaccctgggtccagccccagcgctttgtgtgcgaacaccgctccgccccggacccagctccgccttggggcccctctctgcctgcccctccgtgcccgactacactgcttcccctccggcgggcgactcagcccggtccatcgtggcggcttccagggcggcaggctccgggagtactcccggggccggctccaaggactgttcccctcctccccactcccactccgcggcggcggcgggcgagagcggcgacatagggccagggtccggagcggtggaggctcctggccggggagcacgtcgccccacccggcaacgcgaggatggtggcggcgcagtcggctgctttggggtctcaaggcacaggggacgcgaggcacagatgtcccacagcagccactgcggctcccgcagctgctccgccgccgctgcccgcccctccctgctgcagctggcgtgatggcagcggcagctctggacgccccactgctgccaccatcagccttgtgaaataggtactacc

SEQ ID NO: 391476 - DNA, 471 bp, Homo sapiens
cgcctacttagctggtgactaatatgactgttctatttctcaaagtctacttataatgaccaactgatcaacgcgagtctgatgtctgttccctggcaatcccattcttccttacctttttttactcttccatttaaaacctgctatattagttctgctctcatactctgttgttactggtcgactgataactaagatcgtgactgatttcaagtgtatattattagagaaacatgtaatatatatcctaaagactacttccggggaaaatatattaagccttaagtgttacaaacaagagaaaataaatcagtaaaaatacaaacactttattagacaataaaatcatcttttttaataacttaaggtaaaatcctaattactggagtctttttttctctcccttatcattcccctcttacacctttcatttttcctcccctccggcccatgtttaatggtctattagta

SEQ ID NO: 391477 - DNA, 108 bp, Homo sapiens
attcatagtttctcagaaaacatttcctgcatgggagaaaggaaacattgtgggtaggttgcaggaacccataccctgaagcctctctagcttttaaatcacaaataa

SEQ ID NO: 391478 - DNA, 396 bp, Homo sapiens
aatgaaagtctacctgaaatcatgcctcactgcaaccatgcacttctgggcttaagcgatcctcctgcctcagcctccctgaaggtccacctgcatttgaataaggatggatgtgcgcccaggtatgtctttgtgggtttccatcctatagttctggagcaaaggacaaatggaagaaagttgctaaagaaaagaagagcgtttctgtggctccttcaagagcagttacagatttctgtcctgaagccaggagggaatatgtggcccaggtcccacagtggagagttgcaatgctccctcttgggcatctctgtcctcatttggattcagggctgaaacttcgggatcagtttcacagaagaggtttcaagtagatttcttgcagtcctgaaagtc

SEQ ID NO: 391479 - DNA, 642 bp, Homo sapiens
cgcggtggctcacgcctgtaatcccagcactttgggaggccgagacgggcggatcacgaggtcaggagatcgagaccatcctgggtaacacggtgaaaccccgtctctactaaaaatacaaaaattagccgggcatggtggtgggcgcctgcagtctcagctactcaggacgctgagggagggagaattgcttgaatctgggaggtggaggctgcagtgagctgaggtcacgtcactacactccagcctgggcaacagagcaagaccctgattcaaaaaaagaaaaaaagggtgaatattttgactacacggaaactgagacttctgttcatcaggacatcataaagaaaatgaaaagatatgccagaaactggaataaatttgcgaaacaaaaaactaattaaagattagtatttaaactacatatataagaatacttacaaataagaaaaagataacacattaggcaaataggcaaaaggcttaactgtaattatacagaaaaggagatttctaaggccaacaaacatgaaacaatgttgaatctcactgcccatcagagaaatacaaaccacacagatgtcatttttaaattcattagaatggtaaaaactaggaatgttgatagtgccaaataatggc

SEQ ID NO: 391480 - DNA, 482 bp, Homo sapiens
ctcggccagtcttcctactactacagcttttaaatatttcttacatattaacaaacttaaacttaaatttggtaggatgctttccaacttttttttttctttttaaaaatggctttgactattctaatttctttactttttcatgtaaattttagaagcaccctgtctatatctacaaataatcttgttagaattattttgtggatacattctttttgtacatatttatggggtacatgtgatattttgttgtatacagagaatatgtaatcaagttcaggtatttgaggtatccatcaccttgaacatttattgtttctatgtgctgggaagatttctagttctcccttctagctattttagaatatgtgagacattgttattaattgtagtcaccctactgtgctgtcaaacatgagaacttattccttctaattgtatgtttgaacctatcaactgatttctctttatcttcccccctc

SEQ ID NO: 391481 - DNA, 1226 bp, Homo sapiens
tggcctcccaaagtgctaggattacaagtgtgagccaacgtgttcggccggcctcgtctttttttaagagctgtttgcgtttaacttatttatttatttatttttgagacggagtttcactctgtcgcccaggctgcagtatagtggcgcaatctcagctcactgcaacctccacctcccaggttcaaacaattctcctgcctcagcctcctgagtagccgggactaccggcgcatgccaccacgcccagctaattttttgtattttagtggagatggtgttccaccgtgttgcccaggctggtctcgaactcctgagctcaggcaatccacccgcctcggcctcccaaagtgctaggattacaggcctgagtcacctcacctggtcttaacttaatttttatggctgtatttgctttgtaacttttaatgcagtttacttgcttacataaattctatcaaattacaatccagtttggcagtttgtataaaaacaatgtaatcaaaactttaaaaatcattcaaaactagaatttatccaacaaaagtaaaacaatttgaaacaattaaaaattatttagtgagtttttagacttttgcttgataatgaccaaagcccaagtcacacaatccactgaggataaaacataaataacattcatgaggcagccaacaggcctgcacaggccatctcttgccatatcgagatccagcgatcaatcaagagaaagttccccagtcacggccatctggtcaccataattttgtagcatagatcctgcatatattttgggctgccttccatgaagtcactgtcagtcctgctcatgtaatagtaagattttgttgggtaaggttgagctttggagggctacgcaccattctaacgtcttaactttttttctccctcgccgacaaacctattttgccctttgggtatgatattgcccccgttgagagtgtatgccttttaagaaattattcatgccagatgttccagaatcctaattttttgaattttagaaaggcattatggtgcatataacttgtataacacctccagtgaggtttgggatagaaccctgtatagtcaaatattatgaatgtttctgtagcaaaaatatccagttgaaaattaattgagattatatatataaagactataaataatctcatgtgaggttcagattttgccgccaaatgtgttttgagactatatttactaaa

SEQ ID NO: 391482 - DNA, 409 bp, Homo sapiens
gaaaaaaaaaaagccccaaaaactatcatcttaagtcatttaatccagagaataaccttgtgatatgggaattagtatggtcatttcaggtactcattaggtgctgcctgtttaaacaatataattgactgatgcaagtatttctgaagaatgatctggcaataataaaattaagtatgcatatacccaacagttgtagataaatttttacacaggtccaaaaatcaatgcatatttgcgctgttcactgcagtgctgtttgtaagaacaaaaatttggcagtaacctaagtgaccatcaccagatgaaaatgtaacaaaatataatactttcaggcatacaagggaatactctgtaatagtcagaagcagttgtagatttatatacagtaacacagatttcgatgttg

SEQ ID NO: 391483 - DNA, 726 bp, Homo sapiens
gttttcttgcttgtcaatgcattacagtctacttcatccttttgatttattttagttgatgtttatcaaattaatacatgcacataatctgaaaactagcattgaaaacgctaaatagccaggtgcagtggctcatgcctgttaatcctagcactttggaaggccaaattgggtggatggcttgagctcaagagttcgagactagcctgagcaacatggcaaaaccctgtctctacaaaaaaatacaaaaaattagctgggcatgatggctcacacctgtaatcccaactactagggaggttgaggttgggaggattgcttgagcccaggaggctgaggctgcagtgagccgtgttcatgctactgcactccagcctggatgacaaagtgagaccctgtctggaaagaaaaaaaaaaaaaaggctaaataaaaaacaatggttctctgtcccacgtgtcctgttttcctaatccttttcctcagagacaacctctttctagtcttagctgtttctcctgccatcatataccttcacatttctaaataataggcatatattgctatcaatcatcaattttgggcattacctacttatcttttttatggtaaatcagtttggttctctcactctgccatctctctgctttacacatttcttccccaccctttcaatgtagttacattgcaatctttttgttaaatcagtgtttgcattattgtgccta

SEQ ID NO: 391484 - DNA, 319 bp, Homo sapiens
tgggcacaagcaagccctggcaccacagctttcccagagaaatccctctgtaacctgttcctctgtcagtgcactgattaagttagaaaaggtgagcccacttctctgtggctcgctgacctcaggacatgaggaactgtggatttgaatacacaaggcaacagccgtagtgcagtggatcttctagtggacccgccactggtacacattttcttgactctgaggacattggctgaagagcactcagagcagtacctggtgccatcactcagactttgaagccatgttgcataacagataatgatgtgcgcaatggcga

SEQ ID NO: 391485 - DNA, 678 bp, Homo sapiens
caattcctttatcagcatttttatagaattcacaagaggtgtttctaacatgggccatcagtaaaatccaagtatacaacactaaatcataaacatattgtctaagtgtctaagtttgtagcttttaggtaatctaaactgattcagggctggagctttaaaatcaagaggatgctgggcacagtagctcacgcctgtaattccagcactttgggaggccaacgcaggcagatcgcttgagctcaggagttccagatcagcctgaggaacatagtgagacttagtctctaaaaaaaaaaatttttttaattagctgggcatggccgggcgcggtggctcaagcctgtaatcccagcactttgggaggccgaggtgggtggatcacaaggtccggagattgagaccatcctggctaacacggtgaaaccccgtctctactaaaactacaaaaaattagccgggcacagtggcgggcgcctgtggtcccagctacttgggaggctgaggcaggagaatggcgtgaacccgggaggcagagcttgcagtgagccaagatcatgccactgcactccagcctgggtgacagcaagactccgtctcaaaaaaaaaaaaaaaaaaaaaaaaattagctgggcatgtgatatggtttggctgtgtccccacccaaatcttgtcttt

SEQ ID NO: 391486 - DNA, 333 bp, Homo sapiens
ccccgactagctccgacagagggaggagagaagcgcaggtgtcgtggctcatcaggtccgaggtccaggaggcgggtccggtcctgttggtcctggtcggggccccgactagcccgacaggtggctgtttggggccacctgtcacttgtcgctggcttgtcagggctgcccttgttgggttcctctcaccatcactcagaaccatggggactctggccctgactgggcagtcctctaaccctcgtctctctctccctctcgctagagtgctgtgttgcgggcgggggcctttctctacacatttgtggctcttgctgtcacccacacacctga

SEQ ID NO: 391487 - DNA, 280 bp, Homo sapiens
ctttgaaggtctacagcaagtggtctaggctaactcagtgctgggcaaatggagcaaaaactcttttctgcttccttgcctccatgtctttcagagctagcagatacagcttttgttctataggagtgattctttctaaatgtcagctcaacaggatgatggtcactcttgtatatcacttaggcatgagttctgttgaatcccagcacaatttaccagactttgtcagtggcttttggagtagcaaagactcaatttttaataaagtgttattttgttt

SEQ ID NO: 391488 - DNA, 317 bp, Homo sapiens
  misc_feature (38)..(38): n is a, c, g, or t
  misc_feature (43)..(43): n is a, c, g, or t
ttcagacaggggaggggcgaatggacgggacggcctcnggggnacagagagacctctgtggctgctggggggctgtggcatgatgggggagtggacacgacgtggaattcttgggatgtggagcctgaaggcatcgagggctgttcctcaggcaagagatgagtggggcgaggtcaaggctgaggatgcagagctgggagtcattagaatctctgcggagtgtctgatgtgctgagaaccgttaaaatccatgaatgagtgagtggttaaatttacatttttctgcagaaaaaaactttttgaacccacccacccta

SEQ ID NO: 391489 - DNA, 454 bp, Homo sapiens
ttagcctctctgatcctccagttttcttgtttgtaaaatggggctaattatagcaccatcctcctaggattattacaggaattaaattatttaacagatgagaccaaattcgcactgcccagaagttaataagcactagataaatgtcagctatgattattagttactaatctaattattatcattaggaagtcatttaatttaactgatttgactggtaggttcttcatgagttatcaatcacacagagatttaccaaggaaaggccataaagaaaagaaggaagaaaattagcattctttgtcagcttcctacacatgtgatcatttcaggtcaggatttcacattccctgcaaaactgagattgtgatccccagtttgcagatgaggacaccaaagtttggagaagccaaggcaatagagtcagattccaaagctaataaatttattatgg

SEQ ID NO: 391490 - DNA, 564 bp, Homo sapiens
aactatggctctacttcttactagtgaaacccctggagaagcaacttaatgtctctgaacctgttatctatcatttgtgaaatgggagataaaacttgcctgaccctaaccccagcactttgggaggtggaggcgggcggatcacttgaggtcatatgttcgagaccagcctggccaacatggtgaaaccccgtctctattaaaaatatactaattagccgggtgtgatggtgggcgcctgtaatcccagctactcgagaggctgaggtagggagaatcgcttgaacctgggaggcaggggttgccatgagctgagatctcaccattgcactccaactggggcaacagagcgagactctgtggaaaaaaaaaaaacaaaaacttgcctgaccaaactcaaaggatgtccctgggaatcatgtaggattatgtatgtgaaagtacttggtcaactatgaataaaacactataaatatattgtcattgctacataaattagtgtcgttaaacaagtattttggaaactataatcattaattctgtaaacatttcttaatacctatg

SEQ ID NO: 391491 - DNA, 317 bp, Homo sapiens
ggggtcagaggatcacctgtgctcccagccgtctctccccacagggacccccatccctcccctgtgcatctaactgagtcctatcaatggggtcctcccacggcttttaaatatcctccattcaccccttgccctggagccgataaaccttctcccagctgggcagggctgcaggcaccaatgtgggggactgcgggattcaggggtggcaccaggggaggaacccctgtccacctgtctctcagagggtacaccgggattctcctgtcaccaggagaatcagaggcagccccacagagggaacaggacccatctat

SEQ ID NO: 391492 - DNA, 377 bp, Homo sapiens
ctgaaatgaaataccacttttcatttgacttccaggtcatcagcttcctttgttcttctagctctgttgccatctcctcagctgtctttgttctttctcatcttcctgacttctgaatgttaaagtgtcctagggttcagtcctcagaccctttctctttacactgatgctttaggggacctcatttagtctcttgtcttcaaatacctttttatactgaagattgtcccaaattaatacttccatcccagactaccagctcttgaactcagaccaaaatatcaaaatgcctcctcaatatcgctacatggatgtccagcagacatctcaaacttaagatgtctaagatctaagctcctgccctcgctctccctttg

SEQ ID NO: 391493 - DNA, 327 bp, Homo sapiens
cttagatgtgatctccctgtgacatcccctgatcactgatagcagcaaagagatctcctctaggatttaaaatgccttaaaaaatcaatggcacctagtataaaatactaataaagtaaataaacatgaaaagcaatttgaaaaagttctttgatattttgccaatatctaaaacctatcaataaatataacccagtcattgaggtacatcaagacataatgaattaacaaacctccagcaggcttaaaatatgtaacaattgtatgtttcacttggttagaaaaaatgaaagtgttttctcccaaagaatgatttattaggttgcg

SEQ ID NO: 391494 - DNA, 388 bp, Homo sapiens
accacagagatatttgtcaaaaagcagcggcaaagtcttgaaagtagcccccaccaaaaaattctgtattgctttgccttcagtttcaaaaaaggaacacttcctcatgttttcttcattatactcactcaaaaagaaatggagtctttctattgctttaaaaaagaaagcaaattataagaaagaatatttttagatcaatcacttgagccccttaagattatacccaggccaggcacagtggctcacacctgtaatcctagttcttcaggagcctgaaatgggaggagaagtgcttgaggccaggagtttgagaccagcctggtcaacacagtgaaaccccatctcttttgtttttaaataaattttaattttaaaataagaccaa

SEQ ID NO: 391495 - DNA, 369 bp, Homo sapiens
aagacttcaatctaacgaggattaatacgttaaggaaatggacaaaacgccggagagtctcagcagagacttgaaatttatagaaaagaatctcaaggaccttccaggactggataatacaatacccgaatggacccactgaacagcttttttaccagcagcctgaacacagcacaaaacacaattagtggaatcaaaaggaaaccaatgtttacaagaccaaaaccaaagtgtaaaaggaaagaacaccgtttagggtagtacaagacagtgaggcaacctctaagatacgtgtaaatgagtgacagagaaagcaaagaaggaggcagcacaaaatctgaagaggtaacagccaagaattcttcaaaa

SEQ ID NO: 391496 - DNA, 730 bp, Homo sapiens
ggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaa

SEQ ID NO: 391497 - DNA, 453 bp, Homo sapiens
gtactttccacaggggggaaggagatgggagggggtggagagtgacgttatagtttgaatttataatttgaaagcagagaaaatggatgaaataaaaagattaccatatgagtatcaccagatcctccctcccacacacacatacctatccccaggcaatctttctgtgagaatttaccttggtgtttaaaaatcacggcaatataaaagtgatattaaaaatagtatactaccactgtaagaagtatgacaaacatgtgagatcctgagaaactgcagaatattttctcattcaaagtttagtaccttggtcttatagtgtttgacactaaaaaacatagcaaatactcttttatatttagcctattccgtgatgccttgtttcttaaattaattcatgggcaatgaatgggggaggaaaaataacaacaacaaatatgccctgtggtatag

SEQ ID NO: 391498 - DNA, 353 bp, Homo sapiens
gaccaaggtttgtgtagaggacctaataaaccctaactgtgttaaggatacatcttttcttctttaaatagagtgtttagtttatgtagtggttagggattggaaaggcacacacatcactgtcctccttggaattttggctagagggattagatgggctgaggtgttccctgtagttgttcttctgacaggttctttgttcctcacaaggtgacagcatttctggaggtctcagcacatcagggtgcagtacttatgctggaccaaaatcactattaaatatgagcaaaggagctgggcacggtggctcatgcctgtaatcccagcactttgggaggtcaaggcatgaggat

SEQ ID NO: 391499 - DNA, 209 bp, Homo sapiens
gccacttcacctatccacatccaatcccaaaagccctttacacctacaaacgcacaacgcccaccccaacaaccaagcactccacacaccacaacaacctttacacacatgcacccaatgaccaaagtactttacacatgcaacccagaaatcagaagggcttcacacatctgcccaataagcaaagcacttaatatacacacgcacag

SEQ ID NO: 391500 - DNA, 236 bp, Homo sapiens
ggtacaatggagctctgcagaaggccagtcacagctcagcaaggtgagcctggaggaggagggtggccatttctagtccactgggtggagatcaccagttaaggagcccactggcttctgccctacagattacaaaccatgtaataccctccagcccatcaagtggcaaaagccaagtgactgctttgcttcccaaagctctaaactctgggaaccccagggcctggcatggtgcc

SEQ ID NO: 391501 - DNA, 352 bp, Homo sapiens
atagggtggccaggcaagactaccaagaaggtgactctaggcaaagatgtgaaggaagtgaagggctgagccaggtgagtatgtggaggggaaaatctccaggtagaagtgacagcctgtgcaaaggccctgaggtgtgtttgacccagacccttggggagcacccagtctgatggaggaggctgatgtccgccagggacagtgagcaacttttgagacataatgcagaatacaggagaatagtgtcaaagccagagagagggtgccaggctgcagctgtggccgagcaaagacgtgatcttccacgggtcctcccttctcacccttagcaacaacctccttcgtggggtgg

SEQ ID NO: 391502 - DNA, 362 bp, Homo sapiens
gtgagggtatggagaaattgtaaccttcttacgttgttgatgggaaagtaaaattgtgcagctactgtggaaaatagtttggtggttcttcaatgttaaacatagaattaccatatgatcctgcaattccactgccagatatataccctctccaaaattgaaaacaacgacttaagcaggtattgacatagcagtgttagttgcagcattattcacaatagcctaagaatgggaacaacctgagtgcccaccaagagatgaatgaataaagaaaatgtggtatacacatacaatggaacattattcagcactaaaaaggaataaagttttattttattttatttttgagacaaggtctctct

SEQ ID NO: 391503 - DNA, 220 bp, Homo sapiens
tcaccttcatgcagtagttccttcccgctaccttccagacatgcacgcgcatgtaaatccccggacaaaaactcaatcattctgacggctttcatagcaaccgtccggctcctgattcattcaaagcttctcttcatgaacctcttctccctgtgctccttttttgtggaagcagcagtttcagcctgggcagctctgagacagtgcaaagaacactgga

SEQ ID NO: 391504 - DNA, 221 bp, Homo sapiens
tgctgggattataggcatgagccaccacaccgggcctctataaccactacttgtaaggcatttcagttctatcctctttgggtaaatatgcctctcttctttcctaaaactgtttctatagtggcttccttggttcgaaaccaaactgccacctctttccacatgacgggacttgtaaggtctgctgccccagttgatttcagtaaactgtcaggtcaatc

SEQ ID NO: 391505 - DNA, 171 bp, Homo sapiens
attggctcacatggtagcaggcatttggttataccaagactaatagcaactcaagtatttcacaaatcaagagtcttgaataatttgttactgaaagtatataaatcattctctttgtgactttatgggcaaaaaggaaacttgtttatactttttttctctttatgaact

SEQ ID NO: 391506 - DNA, 397 bp, Homo sapiens
caagtggaatgtatttccttagcaaaataataaattcaagttccttgccatatctctcgagtccccaggtcttctccaggtctctgacctctgacgttaaactgctttattctgtaacagtcaactctgaattacccaggagagagaaggcttggaggtatgatgggctgatctgagcactgactttgccatgccctgcaccaagcttagaataaaattctcatcctgtattcacttgcccaaggtcacataagtggtttagacagtctgcaatttttaaaaaattccaagccccactcttacttatttgtttcttaaggcaatttagcatcagttctgtcatgaactagcaattgatgttatctctctgggttttctcatctgtaaagtgagggaa

SEQ ID NO: 391507 - DNA, 319 bp, Homo sapiens
ggcccactccggaccagggctggggcggcctcccaggcgctcactccgctggcaccccaccggaaaacacgtctgcggcccgccccctcccccaaagcacgaccactccgcccgggcccctcgaggatccactcaggttcacgacgggcccgtcctctcggtggtctgaccaccggctggtggagtgggctctggggccgccaggcgaccagggcgcaggcgggggcggacagctcattgggaggggcgccggggcacagtgcggggctcgccccacccccaggtgccccttccccgctctcgcctcgcaggcaccgca

SEQ ID NO: 391508 - DNA, 276 bp, Homo sapiens
ctaatccctttaaaaggcattggattatctcaaccacaattacaataaaaatatgctaagaatttaagttaactggtattccaaagttttttccactgacaggaaaatttcagccgggaaggctctattgcaaaaagacagaaaagtgaaggcacactccagtttcatacttagaatgttgcaatcactgctaatcctctgattttaataataactcttggttgataaacttaaacatgacagttttgagcaggcaccttaagttctgtatactac

SEQ ID NO: 391509 - DNA, 278 bp, Homo sapiens
ttaatcttgtttttcctttaatatatattgaatccatccttatttccaaccctgtgactctaccacctgcctttagttcaagctcctgccatttagtttagtttatgtcctgccattacttcttaatagttctagacttgtttatctcactgtttaaaatctgttagtgtttccccaatggttacagaataagatctaaactttatgtgacatctaacaaccttctttatcaggcccccacctccctctccagctcaatctcttaccacttgcataag

SEQ ID NO: 391510 - DNA, 710 bp, Homo sapiens
aatgtgatgtcacaaatgacaacacgttgggaagggtttaaaatataattttggtcacattctttagctcagattgaattttataaaaacctgatcatcaatcctctaattcatcccgagatgaagagaggcctagacttctcttcattactctagttattcagagtttttttaaagtagccctatgagagttgcaacaagtaaattctcctggagttttcgtgataaagagggcattttttccacaagctgaggacggcttcatagaagagcagatttgaatgaagacatacaaactgatagacatctaaaaacaatatagggaaaaaatgcaacaaagagcaaacaaataaaccacaagcgttcttggagctttcatggagtttctatcagccttttactttaggcaaatctctgatgaagagttcagatttcatttccgctaccacagcagttttccagagctgtgccatataccatgaggtactcaagatgtttgcagtttcagggagacctggagatcaaaactatttccacaatgatagtaaactgatatatttgccttttttactgtgttgaaatttaaactcatggtacaaaacgagtggtggataaaaccattgatgctttcacaccaatcaagacaagcgaaagcagaccgtactactaaactttttataacttccctctacacaatcagagggagaaac

SEQ ID NO: 391511 - DNA, 793 bp, Homo sapiens
tgaccatttaggacttacaattgtcttaggttttcagtttgcctaagcataaaaccacaaagtgagatcctttacatttcccttatattttatgcttatttgtcttgggagaaggaagcctttcctttttggcagaagtttcaaatggttcttatttcttgtctcactaaggcagtaatagcatagtgatggacctggttgggtagtgggggacagctgaaaaggcaggagttttacttttgtttgaaaagagaccacatcacatatagcatctcaccattcacaaagtgtacatccaccgatactactccactgttagagccttcgtcctcctatggcagtagtataagaaaccttccaccaagtcagagtgctctaactgatgccaaacctaaacctggaaataaagattttcctggagcagtaagacttcagactgttggttgagctattatctcaaggtagataagaaagcctttcagaaggtgagcacaaggttctttgaaataactcattggtgtctttaagctgaagcctttaagcaaagacagcaaagaaattgcatctgaaaatgaggaattcttccaactgcaccagttctttctaatgtgccaaaattagcttctaatttggctcctaaaataaaggtttccctagtgaggagaatgcatttaaaaaaattttttttgtaatatggcaaacttctaccttaacggggtccttggttctaccagagacataagaagctatgaatatttaataggacaaagatggcattttaagtcagtatgtg

SEQ ID NO: 391512 - DNA, 328 bp, Homo sapiens
cccacaaatttccgcaactctcctgatgagaatcatccacattcatttggcccttttgcagtttcaagaaaactgtttatagtgtacaagtgcacgccaaagtagcatccaatatgcaaacctatcacatccaaatttcatcacatacacatgtaagaatctgcagcaaatgagaagataaaggtaagatgcacctttattttatttaaaatttttttttaaaaaagtcttgctctgttgcccaggctggagtacagtggcacaatcacagctcactgcagacttgaccgcctgggctcaagtgattctcttgtctcaaattcccaag

SEQ ID NO: 391513 - DNA, 727 bp, Homo sapiens
gtagagagggctgactaccacttggctaaccatgggacctgaatatacatagatttgggtatacttgggctgtcctggaacaagtaccccgagtataccgagggatgagtgtactcttcttcataagtatttaaaatttaccaaatatccttaatcctttgtctggttgtgtactctggtgtacatgtaatgtttggtggaaattgtattgtttatattctaggacatgtttctctactcacctctctcatcccacaaattgcctttccagtgattagcatgtatgtaataaaggatttattcatttgacatgtatttgttgagtgtttcctataaatctggtactgaaaagtacagagagaatggtattagctgccatttatcagtactaagtgctttacatacacagtgtcattgagtcttcatagctctttgaggtataagttttatacctagggatcagaaaaatttaatttacccaaggtcacagttaattagaggctgtcttgaagcaaatttgacttctatagatatttgtctttgaacttagtaagtagtagttaagggagagaagaatcagtggttttaacaccaagctagagtgctttagtattttggaagtgtttatcctggggtgggactcaaagcccttttctccctaccaccaattaaaccatagcaacattgcctttgtttctcttacctgttgggcttctgagtaagatgt

SEQ ID NO: 391514 - DNA, 660 bp, Homo sapiens
cagagaagttttaactctagaaaatagagacttctggtttccagtctagcatgtagaaacatagttgccacttgcttctaacaacaaataaaaagctgaacaaactgaaaaatcagatgtctttgatctatcaaataagtgagaccgcagcacaaaatgcttcccccaaaattggagagacagaaagatacaaagaattacaacttactggagcagaaatacatgagcagaaacctctgcaggaaccagtaatgagctaagaaaccctgaaccataattcataaactgctagaggctcagtgtagacaactctgagagttaaaaactccaggaggacccagtcataggaggcactccacacttttgtgagttttactccaggagctatatcaagttctcactgtaaatatctgataaaaattcccttttgcttctggcagcaggagaataaaaggaaccaacttgatctatgcattcaatgcaatcccagtcaaaatcccagcaaattattttttggatattgactggctagctgattgtaaacttgatgtggaaagatgaaagacccagataggcagatcaatattgaaagagaagagcaaagttggaggactgatactacccaacttcaagacttaccataatcaagattgtgtgata

SEQ ID NO: 391515 - DNA, 749 bp, Homo sapiens
tactcatgtttctatctagtaactacatttatctgaaactctagaataaccgatgtacagagtctattaatcagattcagaggaggtttctcttggtctagacaactgtgaatgaaacaaataagttatcagttggtctaaaacaatcatcttagtttttttgtgtgtgtgtttgttttgctttttgagactccatctctaaataaataaataaataaataaatggaaatattttaaaagcctaaaacttttaatcctcacatcagctctttctattagataggtatcattatcatctccgttttacaaataaggacattgaattactgggatgttaaataacgtgcgcaaggccacacagccaaggaagtagtaaagagaagggtcaaagagccaggcagtttagctcaagtgtactgccttaaccaccaggctatgctgcctgttataaaaatgcagtatttaaaacagcgtgatactggcacgtaatttgacaaaagaattctcttatcccaatttcatactaaatgaaataatgtatagcatgtggggccagagctggaacatgagacctgagacctaactgtaagctattgcctaccaagatgcctttcttaatgcatgggcttctttgcatagcttgttacaataatacaaatagaggttattttttttttcttatttgcagtgaacatagcaacaaaaaaaaaagactgtttactttgagaagaatgatctttgggataata

SEQ ID NO: 391516 - DNA, 697 bp, Homo sapiens
attgcagaggggcgtgaggtttcaagatggcggggctgaagggttgaccgccaggctgaattgaaggcccttacaaagtgaaagagggcaggaatcgcacctcttggctgctcgcagtcctgggagcacagcagaagtgtttttcttttcttttctttttctttttttttaaatgaacaagtaaaccatacaaattgtcaacatgggaaggagatctgcatcatccaccaagagtggaaaatttatgaaccccacagaccaagcccgaaaggaagcccggaacagaagaacaaaaaacagctcatgatggtttgagctgaagttttaaagatgaaggatcccaaacagatgatccgagacatggagaaattggatgaaatggagtttaacccagtgcaacagccacaattaaatgagaaagtactgaaagacaagcgtaaaaatagctgtgtgaaacctttgaacatattctatgactctatgaaaaagaggatccagatatttagaaagaattgagaaagctagaaatagagtatgaacagaagaggactcaaccaatatttgaatgctgtcgagaatgcccagcacgtggaagtggagagtattcctttaccagatatgccacatgcttcttctaacattttgatccaggaaattccacttcctggtgcccagccaccctccatccttaagaaac

SEQ ID NO: 391517 - DNA, 276 bp, Homo sapiens
tctttggttcacagtgtggatgcacgactcaaggggttgacgcttagctctttgacatgtggtgagaccctcaaggatcgaagaaagcaggatgtgtccacagcttgaaataatccctcttctattttagagggaagataccaagaaataaaaaaagagaatctgtgtcagtaaatcctttaaaaaacactgggggtggtttgacaaactgtacagttcgttggtttctacacttcatccaggattggtttctgaataaagttttggctgtggtgg

SEQ ID NO: 391518 - DNA, 243 bp, Homo sapiens
cttaaaggagattggtcagagtgctcaactagcaacaccctgtctagcacagaagtcattctgagcaacggcatgcagttgtcctaccaagagagcgtgcaggtcatagagtggtgagaccactgggaggaggtactggaagaccaggggaacacaggaaagagttcaggtccatttacaccaggagcctgccagacaggcacccaagaatggacagtgggttactgatggtcatagagaggg

SEQ ID NO: 391519 - DNA, 324 bp, Homo sapiens
gtgagtgacagacacacaaaggcagctacgagactatcaaattcactcagcttaatttttgtggtggttgctattatctatttttatttgtgtatatttgaatgccaaataccaaaattcaagcataaactttgtgatggattgtttgaaaagtggagatttattaaatgaggaacgattccttttgaaactttttgtgcagtatgcaaaaatggagaaagacaccagcacataataacagctaaacatggaagatatatgatttcctcaactaatatataaaattgtaaacagtttttttttattaaaaagaattcaaggcca

SEQ ID NO: 391520 - DNA, 450 bp, Homo sapiens
gatgctcagccatcgtgtttcagccctcatgctgtaagcgagggtcctttccatgatacgtttaatgctgtgtttttgaattcttgtgtttttcactggtgattttgtcatgtgaaatggcttccaagcatagtgctgaagtgctctccagtgctcctaagcacaagaaggctgtaataagaagaaatctggccaggtgccctggtgcatgagaccagcctggccaacatggtgcaaccccatctctactaaaaacataaaaatcagctgggcctggtggtgtgcacctgtaatcctagctactcgggaggctgaggcatgagaatagcttgaacccgagaggcggaggttgcagtgaaccgagatcatgccactgcactccagcctggatgacagagcaagactgtgtctcaaaataaataaataaataaataaataaaagaaaagaaa

SEQ ID NO: 391521 - DNA, 338 bp, Homo sapiens
gccagaatttgttttcattctttattttctttccctagctttttattgttgttgttatttagtttttatttcataatcataaacttaactgcaatccagctaggcatgtaagggaacaaggaaaacacggaacccaaagggaactgcagtgagagcacaaagattctaggatactgcgagcaaatggggtagaggggtgctctcctgagaggagagcacagaaggaatggtctggtggtgaagacaaaacaagtcaaacttactagacttatccacagtcagcaatggtgatcttcttgctggtcttgccattcctggacccaaagcgctccatggcc

SEQ ID NO: 391522 - DNA, 414 bp, Homo sapiens
agtattactttgtcatgtgtctggcttacttagcaatacttctgagattcatccatgttgctgcatatatgattagttcttttattcctgagtatttcattgtatggatataccacaatttgtttatccattcagttaatggacacttggtttgtttccagctttcgactattataaataatgctgctacaaacagtcacatacaaatttatgtgggcattttttaatctcttgggtaaatatctaaaaatggaattactaggtcatatgttaagcatatgtttaacttaaaaagacattgccaaaactcttttctcttttgcactcttatcagcaatgcatgagagttaccattgctccacagtcagtgtttttaattgtagccattttagtgtgtgtgcagtggtatctcac

SEQ ID NO: 391523 - DNA, 450 bp, Homo sapiens
gttatcttcagcctgttaactgttgtcagccctggagagaaaccatcccttctccttaaaaacatgaaccacatactaagttgcttcttgcctcttaaagattcaggtcactcaggtacatcagactgagacaggacgctcaggtacatcatactgagacaggacactcaggtacatgatactgagacaaacactcaggtacatcatactgagacaggacgctcaggtacatcacaccgagacaggacatgttgattgttggtgtgtatttctcccaagccaccactcaaaccagtgtttgatttccatggaggttggctgatggcttttagcttgagccccaacagtgtgacttcatacaaggcaatttcttcagaaatatcatggaacttcagggacattatattattaaattaaaaaaacctaatatgttaaaatttttcattaaag

SEQ ID NO: 391524 - DNA, 272 bp, Homo sapiens
gaaatgttttgaggtttctaaacagtatcatttatttcaatcttcattatcatttattattactgaaaatctctttctacttaaggcttgaaatcttgactattgttgctgagacaaaagttcagtcatttgatgttaccattagtggcaaaagtttttgttcctttattgaggacttaccgactgctgaaaaagaccagctgatctagggtcaggcatgattgtaaataatatgtttcaagagatgattgttgaatatattcttaaataat

SEQ ID NO: 391525 - DNA, 499 bp, Homo sapiens
gaaagctaaggcaaggggattactgtattaataaattctcatgctgttaataaagacataaccaagactggataattcataatgaaaaaggttaatggcctcacagtttcacatggctggggaggtctcacaattattggagcaagcaagagactttgttcaggggaacctccacttataaaaccatcagatcacgtgagacttttttgctatcatgagaacagcatgggaaaatcccacccccatgattcaattacctcccacagggtccctcccaggacatgtggagattattacaattcaagatgagatttggttggggacagagagccaaaccatatcaattacttaaggctaggagtttgagaccaccctgggcaatattgtgagaagctatatgtaaaaaatatttttacagattaatcatgaatggtggaatgttcctgtagtctcggaagttggaggctgatgtaagattattccttgagttcccaggaat

SEQ ID NO: 391526 - DNA, 380 bp, Homo sapiens
agtgtaatggtatgatcatggcttactgtcgcctcaaattcccaggctcaagtgatccttccacctcagcctcttgagtagctgggcctacaggcacatgccattacccttggcaattttatttttggtagagacagagttttgccgtgttgcccaggctggtctcaaactcctgagctcaagtgatactcctgccttggcctcccaaagtgctaggagtataggcatgagccaccacacttggtctagtattgcttttgatttcacactaaaaaacataacaagagagcatgcttgacttctggcaaaccctaatcccaggagaatattctacttgtatgctttcttttatataaataaatgctgtcctggttgcattt

SEQ ID NO: 391527 - DNA, 232 bp, Homo sapiens
aataagacgtggcctctgctcccatggatcttccagccaaacaggggagagaaaagctctgcataaatgatcacagtacagagtcagctctacacactgatagcttatcagccttggagtctgggtcagggaaagaagagatacatctagctaggggaggaagcattagaatagggcctcacttctctttccaaatttcgggttaagaaattggatgttggagggccgggcg

SEQ ID NO: 391528 - DNA, 754 bp, Homo sapiens
agttgagaagtaaatgtgaacaaaacagacataatttatttctgctcatagcttgacatttagtggaagatatggaaaaaaataaacaagtccacgaaataattgcaaacttccataagtgctatgaaggaagcagagtgttgagacttacagaatttagacaaggcaaggttcttctctgctttaaacctcccagagctccccatgggctgggtaatgcagttccaagtccttagcatggcattcaaggctctttaaaacatcacatcttgcctgatgttcccggccactgatgctctcaatactccaggcacaactaattactggccactccctggacatgtgtgttgtgccaaggagctcagatattgacctgtcagtgataggagtggttctaagcatgatggtgacacaatctcatccaatgtacactgtcgatggtaattctgcagagtgtgtaagagggcctggtcagggagagacacgagaacctgttaggaagcatcagttagggcttcagcaagaggatggcatggcctgaaatgtgagtgggaaggatagatctatgagataccgaagtgatccattcttaatactctgtcatggattggctgtgagggcgaggagaaggggatagcaaatgacttccaactcctagccttgaacaggttgttgagctgcagactgaggcagtaaaagtggcagaaaagtggtcttaagatggtaatactcctttaatcagtgtataaattct

SEQ ID NO: 391529 - DNA, 688 bp, Homo sapiens
gtaagttttatatttaaaagttattttatgatttaaagagtgttaacattccacagtatattaagatggaagctatttgtcataccaaaaaaattggtttctagttatcaagagaaagcttcaagagcaacattccctacgcccctttaaaaactaaatgcaagtaatattcctccaagttttactaacctatgcacacaaatgaactatcattaaatgtgatacttcacatatcgattgcccccatgtacatattagggcacccatagcataaccacaaaatttcctagaattatttattatttagaatttcttagaatattattaagctccagagagaatcttggaaagattcctcacatagtctttttattccaaacttcacagccaaaccagctgtggcccgtgccttgcctgtccctgctcctctgggagaattttgattcttgtcccttgacccaaaacttggcagtgttcccttgagtcttcattatgccaagtctacctacatttgctttgcccaagaaaatgaaggagatgcctcctaccaagttctgtgtaacctgggtcatctgaatcttggagcactattatttgtactgcagatctctctcgggagcttatgaagccaagatatcagcctctacttgagctgtctctgtagacttcagacattgtctgggagttg

SEQ ID NO: 391530 - DNA, 512 bp, Homo sapiens
tgaccctttcccatttacctatttataaagattcccttggtcttcctctgcctacaggatgaatccaaactggcctgccccagcctcgcttcgcgatgcctttatgggtgctgcttctcccatcttgtcctctgcatgacccctacttctcttcagacaccaggtcaaccatcatcatcatcattgctgggaagcattccccagcttttctccagtgtggtactacaaaccacagcatattcaaattattttctcctgccaccagacagcgaaactcatgttcatttctgtatgcttacagtcaggctcagggcctgacctagaacaagtcaatagactggacagttgtcactacaatttggtgtcctcagtgagacagtgtcacgtgaaaacaacacatgggccagggaaaagggagcatgtattgggattttattactcttttggatgcccagaccctgaaccttccttcccatgtctgggagtactaagtcctctcagtaggggaggga

SEQ ID NO: 391531 - DNA, 454 bp, Homo sapiens
tctgaaacctttactaaaatgacaatgaagagatttttaagacatacatcctagggcaatggaaagaacaagacacaggacaggcgataatagctagacagctttggaaactggaaggtagatggatgagtggtaactaattgaagatacctgagaaacttcagatctaaactgattttgagaaaagcttaaaatgaccttcatctgaatgtctaagggagttatgttcccagggggattatggctgcctctgctgcatcacacaggtcaccaggtaagtggggaaagctggcagtgacaggcctcacctagttcccactcagccagcaaggccagtctcattcccaccaccagcaccgagtttatatccaggcagctcatgagtagggctgagatcttgccccaggctacaagcctccccactgagaaagcaagctggcctttcaggccccac

SEQ ID NO: 391532 - DNA, 148 bp, Homo sapiens
aaaaaaaagaaaagaaaaaaagaaaaaggaaaactttacagaaaatttaagttaataaatgcagtttaaagaagggaagctggccaacatcatgagtcatcagagagatgcaaatcaaaaacactgtgggagaccaccacacacctgc

SEQ ID NO: 391533 - DNA, 415 bp, Homo sapiens
gtgcgctcacggcagccctgggtgcctctgcggaggctccacaaggcgggcagactccctgccttcgagcccactctcactggggtggaaagggggagggaggcatggcggccttctgcctgcacccccccccccagaaccccactgtgggctccgcagcagcagctagccgtgctgtcccccgagaagcacggggagtcgggctgggcacaggcgaccctttccagcccttccctgctccaccctaggaacccactgcctaccagaaacagcctatggcactgattttattttaattaattgtttttttgagacacaatttcgctcttctctcctaggcttgcccagcctggaatgcaatgatgcgatctcggctcaccgcaacctccgcctcccaggttcaagcgattctcct

SEQ ID NO: 391534 - DNA, 1027 bp, Homo sapiens
taatataaaattcatttttgtgttagcttggcattatttacaaaatttaaaaaatactcttattcaggtaattctgacatatgctacaatatgggtgaacactgaggatgttatgataagttaaataagccaatcacaaaaagaaaaatactgcataattccgctatatgaggtacttagagtagggatagacacagaaagtagaatggtggtctgcagggcattcaggttccctcaagggaggaatggggagttattgtttaatgagggtagagagtttcagttttaaaagatgagaacaattttggagataatggtggtggtggttgcacaacaatatgaatgtgcttaacattgaactatacactttaaaatgcttgagatagtaaattttatgtgttttttagcacaacttaaaaacttgaaaaaaaaataacacttattcagagatctatcacagaatttgctgcagagtaattttgtattataattgtactgactttaggattgtattaaagtgaattcttacccttgtatatgtcatagatttcttttggtctggtgaagtttatggactctgtctcagaataatattttaatgtatataaaataagacataaaattgcaaagaaaaccaattatattgaaataattaaaatatcacagtaacaaatttttgatatattaatacatgtgcttcaaaatctgtgtgttaacaagatgtattttattggcagatttaatcactgccatgatttccaagtaagataacattgagatacctgtaacaattgtaatgtggtattaacatataagtaattcctgttagtgacaaaaatcacaaatactgatagtaatcaaagtacatgctaaaattttagttagatgttagtaaaaataaaaatataatgtttttctccattaaagttgatggatgacctgaattttctgtatcctttaaccccaagttgaacattccctaaaactgcctctttgctattgagaactttatttgcctttatgttta

SEQ ID NO: 391535 - DNA, 353 bp, Homo sapiens
agaaggcaaggaatgcaggcagcctctagaagccggaacaggcaagagccagaaggaaccagccctgtcgacagcttgactttagcctaatgcgagccacatgagacttctgacctccaatgtgtctgtggtcatctgttacggcagccaaggacactaagacacacactgtagctgcctccaggcactggccttgccactatattttatttcattttcccaggggaaggagcaaatgtttactgagcacatacagtgtcagggcccagaaggctcctcattcactctcttgtacattgtttcctggactctctggacaagaggtgtggtgcgtattaccatgatgattctca

SEQ ID NO: 391536 - DNA, 299 bp, Homo sapiens
gcactaaccacagcaattatggcattaaaatgtcaagaaattagaggtcagaataacagataattttcttctctatgtcagattgaaaattgacattctttgacagtttaggaactctggctgagaaaattatgacagcttaacttattttatacttgtaaagcagtaattgataataaactttatcatgacagcctctgggcagaaacatgacagtacagttctggtacaaagctcttcttaatatgtaaacactagatctgttggatagtagatattatttaaattgtctaaagtct

SEQ ID NO: 391537 - DNA, 322 bp, Homo sapiens
ccaactctacacacatccctctttattaacagaatcaccgcagggaaccctcggatccctttgcattttgcagataacaaaactgcccggagagttcaagggtcttgtccaaggccacagagcgaatcagtaacaaatctggaaagaaaatccagatctccagatcccacgaaatgcttccaacttcaagtacctcccacccatttcacgcacaaaacttctgaacaaccccttccccccacacacacccactcaccacgctcctttctttagctcttcctgcacacactcagagctcccccctcaaccacactggatttat

SEQ ID NO: 391538 - DNA, 243 bp, Homo sapiens
tgagaggctgcacagtctggctgcttttccattgttttggggacacacaaatatctgcataattttgagaaactaaaactatttttttaagtcctctttttgcatcaggtctgaaatgcgtgagagtattagtttatcttgcattttttttgtttatttttctgcacagtccattctgtttttatttctataaagtcttcaaatatagattgaaattgtaagtatgatattcttctgctttgt

SEQ ID NO: 391539 - DNA, 872 bp, Homo sapiens
aggaagccttgtgggaggcgtattgtccaagatgatgcgtattgtccaaacgactcagaagaagtcatttctgaagggttgatcataacttccctagccatgttttacctacagagaacttagttagaatttatgagtacagtatgttaaattacttttagtgtaccttaggcagtgtatttgttttgatacagagacaaagactatatgatccctgagacttgttgcctagtgaactcacaagcagatagaattgtacctcagttatttgggtgatttaaagatggtactatggctacactattcccagctatcgttgtgttacagtatttatacaactggaaacatctctctaaatgacaaccattgtatattgttaaataacttatagtcagtggaattctgtgggtttttctttcctacaggcaggaaattatggtgatgtgttgatatgattatatatgtagactattcagttaacatctaggagttagcaaatttgctacattcacaatcagtatgtaagtcagttgtattcctagatatcagcaactaacagaaatggaagtttttagaaagatctcttcaatatcattaaaaaatacaaaatactctacctaagaataagtctaacaaaagatgtacaagatcttgatggagaaaatgttagaccatgtcaggaagcatttaaggagatcttaaataaatgtagtactccataatgtacacgaattagaagactcagtcgtgtaaagatgttcatttacatttgtagattcaatgtaatcccaaccaaaatattttttgcattattacctctatctactgtgtgtttccttaagacaagggcattcctacgtaaccatagtaca

SEQ ID NO: 391540 - DNA, 378 bp, Homo sapiens
ctaaaaaatttaaatgtgtggctcacgttacatttcaactgaacactgctatgctggttccagcacgaaagacaggtgagatggtgcagagaaaatcctcagcaaccctgcaggcccaggcagggggcatcgcccactccagcctgctgctggcagtgactgtgaccagcgcctgcagcctttcccactaagcggaggcccctccactccccactcagcttcccggagtcttgcaacccccaaggactcctggggtctgatgagaagtaaatggtctctgtgatcagccactgtacacttctggtcgtacggagctgtgtgtcctgtgaatagtctctgtgggacctcgctcggttcgtgttcctcaagagcaaccag

SEQ ID NO: 391541 - DNA, 314 bp, Homo sapiens
gtctaatatgaccagtgtccttaaaagaagaggagattaggacacagacacccacacaggaaagaccatgtgaagacatggagagaagatggccattcacaagccagtaacaggcctgaaaagaaaccaaccttggcaacaccttgatcttggactaccagcctccatccagcactgtgagaaaaaaaaatgttgtttttttaagccaaggagttggtggcactttgttatggcagccctagcacactagtacaatgactgactctagtcaagcatacagaagtgtactgaagccagaagacgtgggagaatct

SEQ ID NO: 391542 - DNA, 777 bp, Homo sapiens
agcggagcggcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttgcttcccgggacaggtggcgggcacaactcgggctcaaccttcttgtgttgaagcttccattgtgattcagaaatggtggtgtcacatgaatccgtgtttggaaggagaggattgtaaagtgctgccagattactcaggttggtcctgtagcagtggcaataaagtcaaaactacgaaggcaagtatagacaaaatgcaa

SEQ ID NO: 391543 - DNA, 1146 bp, Homo sapiens
agcggagcggcgcgccgccctggacggggcgcaccgactgcgcgcgcggctgcgggcaaacatcgggagtcctgcctcagctgccgcttctccagcagcagcttcaggcttctcccgcaggagcttcgggcttctcctggtagagacgtgggaacttttcttctcctggcgaggctgcagaggtgatgggccgctcccggggctcccgcggggaggcggcacggtgagcgtcctcgggctccggtgcggcgatcagtacctagttccggacgcgccggtccgacttggatgccggctctagtcgagtcttctgagctacgataattttttggaacggcagaaatgattggttctagcaacagatgggaatttggagtcactctgaaatatatcctggaataagtgtgtttgactagaaccacatcttatgaggtccccaaggatgagagtctgtgctaagtcagtgttgctgtcgcactggctctttctagcctacgtgttaatggtgtgctgtaagctgatgtccgcctcaagccagcacctccggggacatgcaggtcaccaccaaatcaagcaagggacctgtgaggtggtcgccgtgcacaggtgctgcaataagaaccgcatagaagagcggtcacaaacggtcaagtgctcttgcttcccgggacaggtggcgggcacaactcgggctcaaccttcttgtgttgaagcttccattgtgattcagaaatggtggtgtcacatgaatccgtgtttggaaggagaggattgtaaagtgctgccagattactcaggttggtcctgtagcagtggcaataaagtcaaaactacgaaggtaacgcggtagcgaagagagaggtgtgcttcaatcctggaggggcagcaggaggcggagctcttttgcttggattcccatacatggcccctctgcagaaaatgtctaggatttcagcaacttcatatttgtatattgtgagctgtgagaaggtggcattcacttaactggccagcctctctgcttcgtgatttatttcattgaattataaccacaagcacaacccatttgacatcctctctcggattccaaggagcatactccaaatcagaagaagaaccaaatcgagtcttccaaatggtttcaca

SEQ ID NO: 391544 - DNA, 362 bp, Homo sapiens
agttcgacggagaactctctgtacacattacttgttacctgtacaggtaataacaatgtccacttgtcggatgacctcatttaatttcaccagtcgaactagttcgacggagactcttagtttcctgagcatagaagagaggtaactatatccccttactcttaatcaagaatgcttcaataagcaaacttgaggaagaggtagctggaaactgcagagaagatagtgatccattgtatttatgtaactttctctctctctctctctctctctacacacacacacacaaacacacacacacacacacacacacacacacacacacagagctctccatattctggggttccacatccatagat

SEQ ID NO: 391545 - DNA, 886 bp, Homo sapiens
cccagtgaaatcctacctctcctcttggctcagctcaaatgtcgcctcctctgtagaaccttcaatgagtgtccagtgggaggtcagtgtgccctcttctggactcaacaaccatttggttgggtgctcccctacactctaaaatgagggtgtttagcaaaggtcttatctcccctgctgggctgtgaacaagtgagtagaaggttgctgagcatcgaagctaggataagccagaaaggtggcacttgttttttcagctgccattaaattcctgtaaaggaacttctcactgagggtgctcattctgtgtgtggggaactgcatgaaaacactcctcatggccttttgtttgcaaaggcacagttaggtctgcaaacacagaatttgagcagctgtggcaaagcagccctgatcacatggcccatcttttccattctccagctgtcctgaccaaaggccacgctggaaacagctctaagagccactaagagctgtggaggcaggagtagaggaggaaagacaaatgtcaaaattattggatgatcctgggtagcaactggccaagggggattagaatgggtgacagagcctttcacctttggggtcagcagcatgtctgacttcaggaccagaaggccaaaacatctgtcagctgagcagcagctcctgtgaatgaatcgcctttgtcttgttggaggcggggatgagtgtgaatttatttgctcaacagaaagccatgtaaacctgagatcagatggaagctctggtggtggcaagaagcccagtagcccttcagacagaagatgcccatcaacaatggaaaggagtacacaggacctcggaaggaagggtcctctctcttggcggaaggcccctcacctctttg

SEQ ID NO: 391546 - DNA, 336 bp, Homo sapiens
ggcgattacttcctctatcaaagctcagtttccccacttggagtgggagttgtagattatacaagacaatacatatgaagttcctaacccatgtagcagctgtgcgatggttatggttattcagattttatcaagcacctacaagggcccgatgcaggcagtttcaaccttacagagagtgtgctttcctggttgcaaacccctgaagccctatttacttttatcacagtggctcccaaatgtctggaaagcaggcaggcatgtaggggacgtgctggctcctacacaccatcctatctaaacttctgtagggcctgtattctcagtaacttctgc

SEQ ID NO: 391547 - DNA, 124 bp, Homo sapiens
tagagaaaggagatcacaagaaatcaattcatggtccaaatgaactactacttggagccagtcaaatttttttttatacactgaggccaggtgatttggaaaaggcaattaagtaagtgtacag

SEQ ID NO: 391548 - DNA, 689 bp, Homo sapiens
ctcccgagtagctgggattacagacatgtgccaccacccctggctaatttttgtatttgcagtacagatggggtttcaccatgttggctaggctggtcttgaactcctgacctcaagtgatctgcctgccttgacctcccaaagtgctgggattacaggcgtgagccactgcatgtggcctcttatgttcctttttaaaaggcattgaaaaaatgtgaacatttgatagtatcctgttgattttatgaatgtatcttactcttaacattttttttctttaagatatatctgtaaatgttaagtagtattcatattttattaactggctattttaaaattgaactttcttcccatttggtatataactagcatttttccactttgttttcagaacctgtttcatatccatgcactctgttcctctagggtattaggtatcttcatgttagaatgtaggaatttgctagggaatatttatttattaattgtgtcctatatgttcaacattggaaagtcacttggtgatcatccatgaaaagtcctcttgttttctttccagctattacacattttatctatctagtccccactaatacagatccattatatcttttccatataattttccttgtttgccccaagttatcttctccattgtaagatctcatctggattaattttgaagattg

SEQ ID NO: 391549 - DNA, 711 bp, Homo sapiens
cagtttcatgcctcataacaatttaataaatattactaaaatatggcaactgctaccatggctcattagcaagctgttggtgtaatataaagttatccagaattgttttgggtagttggtttgtcaatataatgcacacagtaatctctgaagaaagtcaggaacatatggtccatgttcatcagctaaccccagggaactgcaccagaatctctcttcttacaactacatgacgttgagaggagagcttgagagaagatagggaaaaaaagaatgggtggaaagagaaacattgattactcaaaccataaaatcacacttgcaagcataaatcaagaatcacaaagctaacatcttcaaggaatctgttaaaatacaagttgaacattgtagcatcagaaattctcagaatatgaattctgaatcttgcttggcacacagctaaagttaatcatttcagcagcagcagtaaaatgctgcatatagcatgctactggccaacataaatgaatctaatgccatctatttaccaaaatcaagattcctttgaatatattttcaataatttatatgctaagatgtacatacatattacactctctctctcaaaagaaacgtcatattttctaatttaaagagacatatcttgtccaattaaattcgtttgagtaggaaactgtagagttaacaactgtcaatgatcatctatgt

SEQ ID NO: 391550 - DNA, 199 bp, Homo sapiens
aactagggaatattgaatataatgaagtcacataaagatgcctccctcacccggacagttgaactaaatgacctctaagtttcttttgaaggccgagattctttgcttctgagatcttaactaggatacaacctgatgggcttgactagctcatggaggaggcatttgtaaagggtgggctttagcctgaattagggca

SEQ ID NO: 391551 - DNA, 460 bp, Homo sapiens
tcagcctctctctgatgacattaccttgtgaaattccttctcctggctcagaagctcccccactgagcaccttgtgacccctgcccctgcccgccagagagcaaccccctttgactgtaattttccactacctacccaaatcctataaaacggccccacccctatctcccttcgctgactcctttcggactcagcccgtctgcacccaggtgattaaaaagcttcattgttacaaatacacagtttcacttgggctagaaaactgtttatcaaaggtaacaaattccatgttttaaataaatggaatttatcttaagtttttaaagtaacatctttagacagatgcattttccagatttacatcttattgtagatgttattgtcaatagacaatcagggttaaaaattattggggctgagtgcagtggctcacatctctaatcccagcattttgagaggc

SEQ ID NO: 391552 - DNA, 398 bp, Homo sapiens
tgtgtcttaaatttcacctagtgtctttatttaaaatgacggtaaactctatttcatatcacctataaatgaataccctaggaggcctcatgataacgcatcccaccctgaaggatcccaaagccagcattttgaatcatggccttggccgagagcagtgtttaccctcttggtgagctgtgagctctttgagccaaaggccgcaggaccagagaaggccttgaacgcatgttaattcatggtatgttttccatcagagtccctgagaatattctttacttgggatcgttctgcagttgttatgtgtgctcagtaacttcccggaactcagtgcctgatctcttttgttttattagcctcctggttctctgaccccctgaggatcgcagtgacctgac

SEQ ID NO: 391553 - DNA, 728 bp, Homo sapiens
gggtctgtctcacatcatatcatcctaacagtgactcttctttctccctcttccacatttgagggcccttgtgattacagtaggcccactggataatctaggataatcttcctattttaagatcatctaattagcagccttaattccatctggtaccctaaattcccttctgcatgttaatgtaacatattcataggttctggggattaggacagggacatctttgggaagccattattctgtctaacacattttgtcttctgaaagggtaaattatgtatactgaactgactgtaacaatgtagattatgtgagataggagatctgactgatgcattttattaccacctgtttgccagaattatattcagactcctttctagacttcttctcatgttggttggttggtcttgtagtttcctagtactttatgcaggtgactgcactcctacattgtggacattttctataccagagtcattcaggactactgttgagaaaatgtcagtgtttgccatctcttctcactcctggtaagtacagtcctattaagtaatcttttggttgtttactttttaccaaaaaaaggcctgttcccatccttatctatcatcaagtctctcaccattatcgtagttgatatgtcttaacatctagtcattgagggtgcttttatgacacttttaattttaccctgattttcttgatgccaactgtactctgttctt

SEQ ID NO: 391554 - DNA, 657 bp, Homo sapiens
aagcagtggaagcagaagcagcagaagcagtggaagcagaagaagcaacagaagaagcagaagaagaaacagaagaagcagaagtaacagaagaagcagcagcagaagcagaagaatttcacaaatactgaactaattttttagattacataatatacacatagtattattatatgcacatgaagttcaaaaacaaggaaaactatattgtttaaggatgtatagctaggacttaaaattatgaagcaaagcaaaaaacagtcacaaaggtcaggataataactacctccactgaggggggatatgttgacaaggatggtgaggttggagggaagcacttctggcttgttgacctgggcaatgacaacactaatattcactttattatttcccttaaactgaacattttatgccttctcttgtatacagatggtccacaacttatgacggttcaacttacagtttttcaactttagcacagtgcaaaatcgatatgcattcagtagaaaccatacttcaaattttgaatttttatcttttcccaggctagcaatatgcagtatgatactttctcataatgctgggcagcagcagaaagcagcagctctcacaagggtaaacaactgatcctcaatagatatactgtgtgccagatga

SEQ ID NO: 391555 - DNA, 127 bp, Homo sapiens
aatcaatatgaaactacatatagagacatagaacaggcagagaaaactgggagaatcttctaactttaaagtgttaaaacttagacctcctcaagattttttctgtgatttggcacatgtgatgtac

SEQ ID NO: 391556 - DNA, 442 bp, Homo sapiens
ctccgagggagaggggctttcagtgaaggtgacccagattccatacactcaaggcaaacatgttctgaataggactccacatgttcatttcagtgctctccagagtgagttctaggatccaattttcttactgtttttttaagtctggcaaactgaaaatggacttcttccagaaggtctgtcagagctcaagccttacttgacaaatccaggaagatgccttgacagtgacaggactcagcctgggaaggaacttggcagaccgggacaccttcctagaatcaggcacccagtactcggtttgcctgctttctcttttcggatctcacttctaaagctttgcatatcttcacaatgtatgttatgacggattgaaattgtttaggcccccattactccctgcccaggcgacttgctccccaagccctgctaggtgcagcag

SEQ ID NO: 391557 - DNA, 776 bp, Homo sapiens
tgactgggtaatttataaagaaaaagaggtttaatggactcacagttccacctgtctggggagacctcataatcatggcccaaggcaaaaggcacgtcttacctggcagcaggccaagagggaatgagagccaagtgaaaggggtttccccttgtctcgtgagacttgcttattcactaccatgaaaacagtaaggaggaaattgctcccgtgtttcagttatctcccactgggtccctcccacaacacatgggaatgatggaagctaaaattcaagatgagatttgggtggggacacagccaaaccatatcacatatactgtaccaaattctcctaggtgattttattataaaaatgaactaatacgcatattactttatatcctgattcttttcacttaatgtgttagagacatctttcagaaaatatgttcattcaaaagttcattcaaacttttaataattgcatagtattccattttatagatagggtcattttgtggatatggatataaatagtatttcattttatgaaagtatgtctcccattgacaggtatttatattgtttgcaattttttttcttataaagagcaccgggatgaacatttgctcagtaaatacacttaacatgttagcactggggctatagcagtgaaataatctgactactatccattcccttaaagagcatatattttagttggagaaaggtaataaacagataaagaagtatgtcatatggtgaaaaatggagaaaaatgcagcagaaaaggg

SEQ ID NO: 391558 - DNA, 515 bp, Homo sapiens
gtgtcatcttgaaaatctataatgttgtgttgtgttgttgttggtttgagacagagtctcactctgtcgcccagggtggaatgcagtggtgtgatctcagctcactgtaacctccacctcccgggttccagtgattctcctgcctcagcctcccaagtagctgggattacaggcacgcgccaccatacctgcaaatttttgtatttttagtagagatggggtttcaccgtattggtcaggctggtctcaaactcctgacttcaggtgatccacccgcctcagcctcccaaagtgctgggattacaggcgtgagccaccacgcctggcctgaattcattttcttgcagctgtggagaattcgtggtgcttgcttcttcaaggccaacaggagagtctgcttctgtagggtcttatgacagattgttatcactggaatgactgtcttaccgcctttaatgtgcagcacagcctaattaagggaacagctctcccatcttgttctctggtccctccca

SEQ ID NO: 391559 - DNA, 118 bp, Homo sapiens
gtccagcaaaactaaaaggcataaaacagcgctttgctgcggtgttacacgccctcaggcaagcttcatcgaaggcatcccatctgcaatccatgatttctgctgccatgttcttcct

SEQ ID NO: 391560 - DNA, 759 bp, Homo sapiens
agtctccagttggccattggaaatgtattgctcagacttataaaataggaggaacaactagttttgatgaaaatgaaatctacaaactacaaacaccaaatattaatatcatcaaggagctcaaacaaaaaagaagtcaggatactgatgaccatcagcttgaattatcagtattacagaatgttcatcaacagaaattgagggaaataagttgtaagcatcaagaaaatctaagcaattaggaagaaaagattgaagaactggaaaatttgttacagcaaggtggctcaggaattacagtacatgatctctctaaacttcaagagaaggaaaacactattcatgcaagctctacaaattgaaaaagtagagtctaccaaaaaattgaagaatttgaacatagagtaaaagacaaataaaaaattatcttctggggccaggtgcagtggctcacacctgtaatcctagcactttgggaggtcaagatgggaagatcacttgagctcaggagtatgagactagcctggacaacatactaaaacctcatctctatgaaaaatttaaaaaaaaaaaaaaggccagaagcagtggcatgcacctgtactcccaactagttgaaaggctgaggcaacaggatcatttgagcccaggaatttgaggctgcagtgagctattatcacaccattgcactcttgtctgggtgacagagtgagacccctagctgaaaagaggctattggaagaaacaactctgagaaaa

SEQ ID NO: 391561 - DNA, 132 bp, Homo sapiens
catgctttcatttttcctttcctacacaacttcatatattctacactatcttctactttcctacagaacttgacctattaggacaagtgatttaagaccaaaagatcaaaacacaagaatattaagtagtca

SEQ ID NO: 391562 - DNA, 363 bp, Homo sapiens
ttgattaacttttcaaatcatcttgaataaaactttcttataagtcctcatttagcagtatggcagttctggtttacaattagttaagaaaagatcctgtagtaacaggagacttttcctttataaatgttactgttgcaaaaaaaatccagatacttaagtatccacttcaaatattttgtgcatatattatatatgtatatacacacatatatattatatatatgtacaaacacacacatttaggaatgatatgcactaagattatgaaagtatagctacattccttttctttttcatttgatttgattttatttttttgagacggatttttgctcttgtcgcccaggctgtagtgcagcg

SEQ ID NO: 391563 - DNA, 294 bp, Homo sapiens
aggatgggaggtgggaaggattcaggttgtcttctgccaacctctagctcaacagcctcatctgccctgtctgtccccatagaagctgtcagtcaggcctccagcacgtgccctaatggcgtaacccacagacgagatggcactacagtttttgtactcatttgcaccagtacaacccggcataggcagatgagctcaaagatgactcttgtgtgcgatccccacccccagatgctggctacaggtctcctaggctctcttggtcaccatcacctgtgtgtactcggacacagg

SEQ ID NO: 391564 - DNA, 213 bp, Homo sapiens
cccagggtacccaaccgcattttctaggtaaatgactatagatttgaagaaaaggttaaacttttcctaaatctttgatcttcaattgtttaggttatcttcctgtattattttacatcccctcccttaccgtactgccctctaaattttccattttccacttccatttggtcatttagttcatgtaaatagttactggaactttttaatttg

SEQ ID NO: 391565 - DNA, 237 bp, Homo sapiens
cttcagatgagtagcagaaatgtggatgttttctttatttaatcctttaaagtgtatctacatgttatatattcccttccacatgtatgatatacttcataatctaaagaagtaaatgaacctgagtgaactttgttagaaatgcattttaaagtcaatgttacttcaagttggaaaacacaggcatttaggaagttctttttctatatctaagttttgaattaatatttattattt

SEQ ID NO: 391566 - DNA, 197 bp, Homo sapiens
tcatggagaaggcgccattgtttgcctcttgacgcttgtctttctacccgcatgaaagctctttgagagaaaacacagttggtctttttcctttgtttctggctgttagcacggtgtccagcacacggcaggtgcccagtaaatgatgacaatgaacgtgagacccccgggcctcttcttggtggattctctctttt

SEQ ID NO: 391567 - DNA, 407 bp, Homo sapiens
ctgttgcacaacacagtgactatagttaataatattgtatatttttaagtagctccaagagattttaaatgttcacactacaaagaagtgacatgcttttgaggtgatggatatgctaattagcctgatcttatcattacaaagtgtatacttgtgtagaaacttcacattgtatcccgtaaatatatacaattattgtttggcaactaaaataagataaaacaaataagctctgtttcctcactagctctgtttagacaacagagacagaatgttttgtaagtgctcctccatctgtataattgtgattcctaagattgtaatttcatttttacagaaggcatatatgcataatagaaggggattctgttttgaagcaagaataacttggaatatcaggtgatctg

SEQ ID NO: 391568 - DNA, 394 bp, Homo sapiens
cgccatcttggctcactgcagcctccacctcctggattcaagcaattctcctgcctcagcctcctgagtagctgagactataggcacacaccaccacattcaacaaatttctgttatttttagtagagacggggtttcaccatgttgtccaggatggtctcgatctcctgacctcgtgatccacccgactcagtctcccaatgtgctgggattacaggcgtgagccaccacaccaggcctacagtacaaaccttaaccataatgtcttttgatggaaagctgcttacattttttttccagataactccttggagcttttaaagtactccatcttcagaagacaatgacttaaattcacagaattaaaatgttaagtctttttcctattactaat

SEQ ID NO: 391569 - DNA, 461 bp, Homo sapiens
tactactaaattcgcggactgcgactacatccctcacgctgggagctgtagaccggagctgttcctattcggccatcttggctcctcgatcctgaatcatgtaaaaggcactggggatacagcaatgagaaaatgaagaataagaacaataattactcatgcaattagaacagtatcacttgctattactgctgagagtatccctaatcatctatttactgaactgttactaagattctactttggactatgctttgtattgggcacagatgctacaatggcagacaaggtctaaaccctactgggaagaaggtatgtggcctaatgtaaggtttccaggcctgaatatcctgagaaacccataagatttattaaattgtaatatttacagttctacccaaggtatttgtattaaaagaaaataaaaatgtaaaaaaaaattccagatgattctgacaaac

SEQ ID NO: 391570 - DNA, 807 bp, Homo sapiens
aagaaccacgtatgtcaaccaacagtttttagatcttgtgtttaaaagacaagggtttccagcctcctaaattgaggccacctacggtgtggtagaaaatttttaaaaaatgctaaagatgtagactaatatattcaatattgcctaatattcctcaaagaaaggactttgtgttttcctactcgatagtttgtagaaacaaaacaaaacaaaaattgtagagatggggataatctgaagtgtgtacttatgcagtaattaagaatgtacaaatttttataaaatttgaccttcattttacatatgaacataaaattgtgatggcaccatggaaaagagaggataatactcaggtcagtaccttgtacagaaaggcatcgccacttgatttcctttatagacctaccccacaattaacctggcctttcttagacctagaaatattgcattaaaaccttcaaattgtttttttgttcaatattatgattgatgttgcacttctctctgctctcagaagtataataagtaattaagaatagtaacaaaaatagatgcttttttccagtacactgaaatagtaattgcaataatctacagaaactatgtatattaaaagcagcattctctcttctagagaaaaaaattaaatgattttaaatagttggatatgtaagaagaaaaactctcatgaaaataacccctttggatggacatgttgtaaagaagcagtcagttttggttgtgtttggttttattataccttgagttctagggtacatgtgcccatgtgcaggtttgttacatatg

SEQ ID NO: 391571 - DNA, 286 bp, Homo sapiens
tgcttgtcctgcctctgggcggtaccactgatctgcatcagagttgcctgctattctctggtgtatgttgtcctcatgaggatgcaaggagtttaggacagagtgaaccaaagcccagattaagcaaatgtgggcagaataatatgttcccctttatgaacaattttaaattgtcagccaatttcgtcccagagtttgagttttaaatttccctcagtaggaaaccaagggtaaaggagttttacaacctcaaacagttcaattaacttatcagtagagactttta

SEQ ID NO: 391572 - DNA, 729 bp, Homo sapiens
cgtggtagctcacacctgttatcccagcactttgaggggccgaggcgggtggatcacaaggtcaggagttcaagaccagcctggccaatatggtgaaaccccatctctactaaaaatacaaaaattagctgggtgtggtggcgggtgcctgtagtcccagctactcgggaggctgaggcaggacaatcacttgaacccaggaggcggaagttgcaagtgagccaagatcacaccactgcacttcagcctgggtgacagagcaagactccatcccccacaaaaaatactttattgttaaaaaaacactaacaagccatcatcgaaatcatgagtaagtcataatcttttctctggctggagggccttgcctcaataaggatgcctgctgactgatcaaggtattggttgctgaaggctggggtagctgtgaaaatttcctaaaataagacagtaataaagtttgccgtatcgactgattcttccttttatgaaaaatttctctggagtacatgatattgtttgatagcattttacacacagcagaacatccttcgatattggaggcaatgctctcaaaccttgctactgctttatcaactaagtttatggaatattcaaaatcctttttcaacaatgttcacagtagattccatctcaagaaaccactttctctggtcgtccaccataagaagcaactccttatctgatcaagttttatcaagagactgt

SEQ ID NO: 391573 - DNA, 337 bp, Homo sapiens
ctgagcccctcaccctttgtaattagaattgtaaaaagaaaaattgttcattatgtgattcatcatttcttaatgtcacgtctacatatcacccaaatcaggctgcatgggccacctgataccacctgcgtgccctagtcgaccttatgactgggcctccatcgttgcatccccagagcttcaaatgtcacataggaaaattgtaagcacacaacacaactgggtgaatgactgaatgaatggatgcatcgcttagcctcatcattctttctttcttatttttatttttttcgagacagagtctcactctgtcacccaggctggagtgcagtggcac

SEQ ID NO: 391574 - DNA, 180 bp, Homo sapiens
gacggcgtgttgctctggctgctctagatggatccctataggcgctagtgtgacaaaatatctgtacactaaacccccacaacatgcaatttacccatgtaacaaactcgtatatgtaccccatgaacctaaaaataaaagtgggaaagaaaaaaaagtaaaaaacttttgaggatgatt

SEQ ID NO: 391575 - DNA, 280 bp, Homo sapiens
gacggcgtgttgctctggctgctctagatggatccctataggcgctagtgtgacaaaatatctgtacactaaacccccacaacatgcaatttacccatgtaacaaactcgtatatgtaccccatgaacctaaaaataaaagtgggaaagaaaaaaaagtaaaaaacttttgaggatgattaaaaaaaaaaaaagaaaatgggttgaatcaaagaacacaagcttttctactatttggctcagggctctttctgaaatcaaaaccacctccttatactctg

SEQ ID NO: 391576 - DNA, 232 bp, Homo sapiens
acccttcatccatggcacccatgattctactgtctgcttctatgatttaaactgttttagattctgcatatgattgagatgagatactctttgtcttttggtgtctggcttatttcgcttagcataatgtcctccaagtttatccatgatgttgcaaattgcaaaatgttcttcttcttatggctgaacgatattctcttgtttagacacaccacattttctttattaattc

SEQ ID NO: 391577 - DNA, 639 bp, Homo sapiens
  misc_feature (219)..(219): n is a, c, g, or t
  misc_feature (579)..(579): n is a, c, g, or t
tactttaggcctgctccctggctctgtgacagatgtctcatgacaggggggattggagggacagagggacgtgctcagtgtgctgaggggcagacgaggctaccaaagggcaccttggacactggatggccgcaggaaggcccctgaaccccatcctgattgatccagggccagtgaccttggcccagactgcaggcctggggactcaggttcctttgntttcttaagaaactactatactactttttggcatagctgtacgattttacattcccaccagtcatgtgtgaaagctccagtttttactcatgctccccagagtttgatgatttattagagactcttggaatacagtattagtaggatttactgtgtcagtttagctatttatccattaacagtaacaatagtaggaaacacatactgtttaccataggtcaagcaatgttgtaaacattttacatggattaactcatttcattctcacaacactatgaagtatatttataaccatcccccctaagttcagagccagggccctgccacgcctatctccatggtgatgtcttctcactttgncttcctcctgagaaatggcagtgccatctgaatgaaatctggttcagaggaggagagact

SEQ ID NO: 391578 - DNA, 650 bp, Homo sapiens
tctaatcggcgccacacgacgggccttccccacaacctcatctgcttggggacgtaaagggctctgtgggggagctgcagctttcgtgcccatctgttaaaggccagaacttcccatctctgaaatgcgggagggaacagagctcaagcttgaataactgagcgcggcccggcagtcccccaagtgaaggtgctagcgctagagcagcggcagggcggggagcgggaggccgggccccagggaaccgcggggcgcgcccggcgccgcattacctctccagggcctgtagggtgtagctgatgagcggcctctccaggatggggcagaattgcttcggggtggggacccccatcctctccccgcaccccccggcaggcaacacagctgccacggcttgcgggtggcgcccgggctcggtcccggccacgctctgcagggaggcggaagccgtgtggtccgcgccgcgctgaccactcaggcaaggacccggctccgccggcctggcgctgcccggcggcccggcctccatggctgcgggcggaacggcgagccccgctagcctcgggccgatgcgaccccgcgctgctcccaccctcggccggggtcgcggggcgaagggcagaccacggagagggacgcagagcgcgcaa

SEQ ID NO: 391579 - DNA, 819 bp, Homo sapiens
cacatacttgacagttaaaaagagtttctgtctccccaggggttcctcatagctctctctacctctcagtgtttttctctatagttccctagagctgctaagtcagctatttcagcatcttctttggaattccacttgacttttccttcttacaggctacatgctgtctttccccatctgccttcctttaaaacataggtatccctgggatggcagcacgctgagtgccgctgtcagcaggtgcactgggtcagctctccttatgaactggaagagggatgagtgcctagggtaaatggaaggagaactgaccagaagttaggatggggcttgtgtctcattcagtcccagacttgctgggtggctttagacaagtcgcttcacttccctaagcctcaatattctcttctgaaaagtcaagtgaataataacacccacctcattgggctgatgaaagattcagatgagaaattggatgtgaaaggactttgaaactgtaacatgaggtgattttattgatcatctggaggcagggaaagaagccttggggtaggtgaaaattcactttgccaacctcaaaattgcactaagtgttggccctgttaaaaaagcctgatgcaactgaacattcccttaatatagagaatgacgaatctgtatttgttgccagagttgtcacattcttccaagagtgcagacttttatgggcccctggaagctccgccggggtctatttctgaggatgggaacattgtgcttcgttggcaggcttcttaaaccaaggcctcttgtggtcattgaagaatctgggtctgcctt

SEQ ID NO: 391580 - DNA, 361 bp, Homo sapiens
cccaaccacagcgaggtcttgcctttgcagaaggaaattatcacccagagaacccggccgaccgtgtcatgcacacgacgatcccacggtgctgttttctgtcaacagtgtttcccagccattccctcctgcctgccagctcctctgctctccagggctttcactaacccacctgcccaactgaccagcattaggctgtccagttagcccacatctgtccaggggtctcaaaggctcaggaccccaagacaccatccaggtagccaagaggacagggaacccagtctggagagtagaataacgtttcgctccaatttgagatcccaaaatgagatgctgcccgggaccagaagtcagtttc

SEQ ID NO: 391581 - DNA, 151 bp, Homo sapiens
atactcctggcaatcgcttcataactctcaatgctgtagactagggggtcagcgaacttttttttaaaggatcagataataaatgttagttctgagggccataagaactgttgcaatgccaggtgcggtggctcacgccataatcccagca

SEQ ID NO: 391582 - DNA, 811 bp, Homo sapiens
tataagacaaaaagcaattgatacttgtgtatcaaagagaattatctggatatgtggtattaaacatggtaaaatgtatttggagcccaagttctatgaaaagattataaataaggacttactcactctaaatgaatttgtcttctggctcaggcaaatgacattccagggtactgagagaacttgagaatgaggtcactgaacagctctcagtgatccataaagaactgtggccagtggactatgttccagaaggctgatgttaaaatcataaatttctcccaattatcctgtttttttaagtttattataaaaaattttaagcagtttcattttggcagttattttgtagatggtgctatgtagttcatatttcatcacattaggagatgtacttttagtaatgctaagactgagcaatgggttcagttggtgacagtctaatccactataaagtttcccatcaaccttaaacttaattgttttaccatccattgatgaacattgcctgattccgtcattttgctagaggtgacaaaaaggtaattttgaattctgtcattccttttgtattttttattggctaaagtagttttatagagaatactgtcattcaccctagcacacattcgaagaacccgtatacacttcaaactcctaggaacgcaacaaacaacagacaagacacaagaaaccccgtctgtgcggcacacctcgcgcccgggagaaaacagatcaaagacccttccatatcggagcccgggccccaacgggtaacggacaaacgggccaaaacggcaacacaagaaaa

SEQ ID NO: 391583 - DNA, 272 bp, Homo sapiens
gtcccctgaccatgtgttgctcctattttcggcataatgctctaacatgatcctcgtcaagtgcctgggtccctatttgaagctcatggtgtcatcattttttctgtgtgaaaaaaccctatggacgccactaaataagcctttattctaggacagacacagtgcattagtgcacctcatgttatttcttttaggaggtagcacatacctctacatttcaaggagcataaagcaaacccttcagttgtttaagaatttggatcaataaatgg

SEQ ID NO: 391584 - DNA, 411 bp, Homo sapiens
gtgagattcatattatcacgtgacgatcatgctatactcgtgagacgtgttctgagctgcggactcctctttgatcctgctcacctcctcccaatctctactcagcatcctaccccgactgaatctgacactctgtgagcttccccaccaacacatcctctccaaattcgggtgttggaatgggcagaataaacagagctgattacaaatttagccccattctttggatcacagactcaaaccacaagaagcagaaaggacaacaagaatgacccgcagggtcaagactcctgagtctcaagctgggagtgtcaaatgcttccgaaatgctccatgggttgggaaatcaaaaaggaaagggatagtgccagtagaaagaatggaagagagtctcacaataatttaatgcca

SEQ ID NO: 391585 - DNA, 179 bp, Homo sapiens
ggtcatacaggctcttgcacaagttaaatgtgaggggcccggacccgtcaggcatggttcagcaggtggctgtggtctcatcacacactcagcagctgaggtcttttgcggagtgggggttaggtggagagctactgaaataagcatggagaggcacccccctcacctcctgctgggtt

SEQ ID NO: 391586 - DNA, 232 bp, Homo sapiens
gctacaagagcaatggagagacgacagaaacacagtgaatcatgaggttaaagtcagagagattcgatgaccaagggaattaatatttaggacagaggctgatttaaattcattcacattttattcattcaaataaaaacaatttttactgtgggcttgctatataccaggcactcttctaggaactgggacatagcagtgaacaaagttatagccctcatggagcttacag

SEQ ID NO: 391587 - DNA, 419 bp, Homo sapiens
gatgaattataagaagaatcagaatctcggtcatgcaaagacagacccagtttccccagtgattcctgtcagctacaacattttgaagtatattaacattaagccctgaatatgcttcttattttaaatactgtggcatagtgcaattcattagcctttttgaaaggcatagaaaggatttgaagtcaagcatgtcttaaagaagcaaagagactgatagtcaataccaatcacccagacccagaagtggggcaacaagcacggagcacaggcttagtatcaacctgattgtgtctaatgcattctgctgacacctctgcaactgagcgttagcatccatactgttccaattctccatacggcatcttctacagaaacagatctctaagagaagaaatgaaaaagtttcatccaatctt

SEQ ID NO: 391588 - DNA, 3024 bp, Homo sapiens
caagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaatctggctgccacactccagggagaccacgagcgaaacgggggacctggaggcaccgtggcccctcagcccgtgccccacgcctgcagaagtccccaccttgcacctgccctttactttggagtaacctgggcctgctgtctcctcatttcagttcccagaccagagatgcagatgttcatccattaatccacacacccgtatccaacagagccctggctgggtgccaagctccagcccccgcacctcaaagtggggcccaagcacccccagctgctgcctcagccgggagttgctacaaaagcagattcaggccccaccccacaactcaccaagacagcacatgcctttaccattgcgtccggtccagtggaggagacagacgctggcctatcccagcctggtggggagtcgggctccagtggcttgaagggccgtgtcagggacagcctcccagaagaggggtttgtgagctgcatcttagggctcagcagcatttagggggtgaaatgtgatttctggcgcacatactatgtcctggcacgtgaaccagcggagaggcccaggcctcccagcttacggtgcccggggcgaacaatttgagaggctgagatcagctgtgatcaatctgaggctggcctctggcctgtttcggaaggcatcacgcactgcttccttgatgggctgatccccctccctggtgttagggaagcgagagggagtggtgcaggtgggggactcggggcccctgtccggcctcgcagggtttgtggtttggggaagtatgtgttatgtgccatgacttgaaagttcagaacttcaag

SEQ ID NO: 391589 - DNA, 2198 bp, Homo sapiens
caagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccatcccgaccccaccccaacctgccatcagcagcccccacccccgccatttgcagggaggacctgggacacccagcgtgggtcaggcctccacaggcatttctgggcctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacatgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttatt

SEQ ID NO: 391590 - DNA, 1670 bp, Homo sapiens
caagagaagtcctcgggcgcgggctccctggggaatagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacaaaacaaacatgttcactagcggattccattctttgggttaaagctgcctccagcctcaggagcagtgtggaggaagatgagggccaggaaagaaggaaaccttggtttctccatccttgtgaatgtcctcgtctgtttcaaatacagtgcagtcagttttatatgatgtgcaataaaccaaaaaggctttattaaaatctggctgccacactccagggagaccacgagcgaaacgggggacctggaggcaccgtggcccctcagcccgtgccccacgcctgcagaagtccccaccttgcacctgccctttactttggagtaacctgggcctgctgtctcctcatttcagttcccagaccagagatgcagatgttcatccattaatccacacacccgtatccaacagagccctggctgggtgccaagctccagcccccgcacctcaaagtggggcccaagcacccccagctgctgcctcagccgggagttgctacaaaagcagattcaggccccaccccacaactcaccaagacagcacatgcctttaccattgcgtccggtccagtggaggagacagacgctggcctatcccagcctggtggggagtcgggctccagtggcttgaagggccgtgtcagggacagcctcccagaagaggggtttgtgagctgcatcttagggctcagcagcatttagggggtgaaatgtgatttctggcgcacatactatgtcctggcacgtgaaccagcggagaggcccaggcctcccagcttacggtgcccggggcgaacaatttgagaggctgagatcagctgtgatcaatctgaggctggcctctggcctgtttcggaaggcatcacgcactgcttccttgatgggctgatccccctccctggtgttagggaagcgagagggagtggtgcaggtgggggactcggggcccctgtccggcctcgcagggtttgtggtttggggaagtatgtgttatgtgccatgacttgaaagttcagaacttcaag

SEQ ID NO: 391591 - DNA, 390 bp, Homo sapiens
tgacttaactctgtgtttggcacacaatatccattaagaaatgttcacttcattcttgttagtagtaataaattataaaaatgtctgatgaagcgttgtcacaaatgagccaagcatatcaatcagtgaaataagtcaaaaatagtctttctaccctatctctttgaggtaaaatgttaatatccatttcagggaaatagaagaaaaatgataaccttagcttgatatcaagatttattttttaaatgacattagttaaaactaatgcttttcatgagctctgaaatgagttccaattggctaagtcagtagaaaccttactgcaaacgaaattgttatttatttaatatttggaatttgcaactgttttaatcaattaaattatgtttc

SEQ ID NO: 391592 - DNA, 320 bp, Homo sapiens
accagttttacacactgagaaaaagttcctttcaaaagaggagaagacagcccatgaagcaattaaaggaaaagggaaaaggaagggaagaagcaagggagtgagggaaggagagacagaaaatccacctaaccacagggaaaggcgaggtgtcagcaccccccagttttccaagtgaccaccaggcggcactgttcgcagttcccacagctaggtaaagcaacccccttttaaaaacaaaaacatggaacaaatcaccaaaatccttcatcttaactgcggtgccttcatctcaggaggccccatagctacccaaaaag

SEQ ID NO: 391593 - DNA, 144 bp, Homo sapiens
gtattaaacttgtcttagctggaaccaactctctataccctgctgaggtttgtgggtcttactctgtccttcagagtgttaatgaaatttttcttagcttcccgtcgttcaaatgttttttaaacatacctgggtctttcatgc

SEQ ID NO: 391594 - DNA, 216 bp, Homo sapiens
ttgttttacttctacatttaagacatatcattcacactataattccaatatcaatcattgttgctactactaatactattactaccaccactacatctacagccaaaatttgctgtgcatctactataggccagtgctttatctgtgtttttgtttgtttgtttgagacagagttccgctcttgtcgcccagtctggagtgcaatggcacaatctc

SEQ ID NO: 391595 - DNA, 2180 bp, Homo sapiens
ttttttttttttttttgagacggagtttcttgtcgcccaggctggagtgcagtggcatgatcttggctcactgcaagctccgcctcccgggttcacaccattctcctgtctcagcctcccaagtagctgggactacaggcacccgccaccacgcccgactaattttttgtatttttagtagagtcggggtttcaccgtgttagccaggatggtctcgaactcctgaccccgtgatccgcccaccttggcctcccaaagggctgggattacaggcatgagccaccgcgcccggctgaactgatttttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttccccccaatcagcgtgcagcggttttgggaggaggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggcagaaggacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391596 - DNA, 2633 bp, Homo sapiens
gctgctgtcgagtacgggcatgggcccagaagccccagctccatgggctttctcttcttccaccgggagggcacagccaggtcctgagatgcaatgctgagggccctgcctcggctggggacccagctggctcttgtcatcggccttgagacccattgttctctccttccctgcaccctgaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccaccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtcttctcaaactgtcctttccctgctattgctttgcgtttttttgtttgtttgttttttgttttttgtaattgtcaaagaaatcacatcatctcgaactcctgaccccgtgatccgcccaccttggcctcccaaagggctgggattacaggcatgagccaccgcgcccggctgaactgatttttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttccccccaatcagcgtgcagcggttttgggaggaggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggcagaaggacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391597 - DNA, 2493 bp, Homo sapiens
gaggcggatgacggtggcattgggctgttgctgttctcgggttctcgattggtcagcggcagcagcacggggcggctgcgcctgtgggccgtgggggctgtgtcggagctgaggtgcaagggctcaggcgccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccaccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtctttctcgaactcctgaccccgtgatccgcccaccttggcctcccaaagggctgggattacaggcatgagccaccgcgcccggctgaactgatttttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttccccccaatcagcgtgcagcggttttgggaggaggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggcagaaggacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391598 - DNA, 1216 bp, Homo sapiens
tctgaggctcaagaggtcaggaggcccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391599 - DNA, 772 bp, Homo sapiens
gctgctgtcgagtacgggcatgggcccagaagccccagctccatgggctttctcttcttccaccgggagggcacagccaggtcctgagatgcaatgctgagggccctgcctcggctggggacccagctggctcttgtcatcggccttgagacccattgttctctccttccctgcaccctgaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccaccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtcttctcaaactgtcctttccctgctattgctttgcgtttttttgtttgtttgttttttgttttttgtaattgtcaaagaaatcacatcagtccgggcgtggtggttcatgcctgtgatcccagcactctgggaggccaaggcaggtggatcacctgaggtcaggagttcgagaccagcctggtcaacatggcgaaa

SEQ ID NO: 391600 - DNA, 1483 bp, Homo sapiens
ggcacgaggcacatatactaaaattggaacgatacagagaagattagcatggcccctgcgcaaggatgacacgcaaattcgtgaagcgttccatatttttttggactcacccagatctagtgcagggacacacacgggggccggcattgctcctttccgccatgtggagttggccggggcagaaggacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391601 - DNA, 2547 bp, Homo sapiens
gctgctgtcgagtacgggcatgggcccagaagccccagctccatgggctttctcttcttccaccgggagggcacagccaggtcctgagatgcaatgctgagggccctgcctcggctggggacccagctggctcttgtcatcggccttgagacccattgttctctccttccctgcaccctgaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgagggacttccagcctgggcagaggcggggcagccgaacctggtgccctccctgcctgccggctccatctccaccagcccagatgattccaagtcctgccgtcactggctcgcagcggccgccttggggttcccagcggggaagtcttgggtgtgcacgtcccctcaaagccgtcccggttgtgtctgcacaagcgagccgcctggcaggccttgcaggtctttctcgaactcctgaccccgtgatccgcccaccttggcctcccaaagggctgggattacaggcatgagccaccgcgcccggctgaactgatttttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttccccccaatcagcgtgcagcggttttgggaggaggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggcagaaggacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391602 - DNA, 2098 bp, Homo sapiens
ttttttttttttttttgagacggagtttcttgtcgcccaggctggagtgcagtggcatgatcttggctcactgcaagctccgcctcccgggttcacaccattctcctgtctcagcctcccaagtagctgggactacaggcacccgccaccacgcccgactaattttttgtatttttagtagagtcggggtttcaccgtgttagccaggatggtctcgaactcctgaccccgtgatccgcccaccttggcctcccaaagggctgggattacaggcatgagccaccgcgcccggctgaactgatttttttttaatgaagtgcatcgtgttcccacttgcacttaaagttcacatttggtgccaggctgtattgcttcttctcactggtgagtggcagctgtgtctcctttctgccagtccagcagtcccagctgtcagtggcacctgcataatgacacgtctgcatttccccccaatcagcgtgcagcggttttgggaggaggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggcagaaggacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcaaaaaaaaaaa

SEQ ID NO: 391603 - DNA, 619 bp, Homo sapiens
gttttataaaagggagttcccctgcacatgccctcttgcctgctgccatgtaagatgtgacttgctcctccttcacctcctgccatgatcgtgaggcctccccagccatgtggaactgtgagtccattaaacctctttttctttataaattacccagtctcaggtatgtctttattagcagcatgataacagactaatacactatgcatgccaaattttatttgattcaggtattttgggccagaaaacaagacaacaaatgaccaaaaagcttctattttgggagactcaaccaatcagtcaaggtcttcagtgcatatgacttctctaaagggccaataatcctcttctattgagatcttttggagaattccatggaaaggtgtatgcataggtgggaagctctttttcatgatttggatgaaaatatgcttgattataataaatagttaaaaatattttagccaggtgtggtggctcatgcctgtaatcccagcactttggaaggccgaggcaggtagatcacttgatgtcaggagttcgagaccagcctgtccaacatggtgaaaccctgtctctactaaaaataaaaaaaaattagccaggtgtggtggcatgt

SEQ ID NO: 391604 - DNA, 341 bp, Homo sapiens
atagtcccagctgctctagaggctgaggtgggaggatcgcctgagcctgggaggtagagtttgcagtgagcagagatagtgccactgcgctccagcctgcgtgactccagccagagtgagattctgtctcaaaaaaaaaacaaaggattgttgaataaagttccccacctcaataaaaagatgccgaagtgctttggaaaataaagacacatttttgtggagtggctccaccagcaactagttgagtatcctagagcaactgacacccctctgtgctctccgggtcctcactgatattcatttgtaattaatggattaattaacacatttgtaacacctac

SEQ ID NO: 391605 - DNA, 271 bp, Homo sapiens
gtgaaaccccgtctctactaaagatacaaaacttaaccgggcgtggtggcaggcccagctactcagaaggctgaggcaggagaatcgcctgaacctgggaggcggaggttgcagtgagccaagattgcaccactgcattgcagcctagataacagggcaagactccacctcgaaaaaaaataattagggtttctcaatgttggcacttttgacactttgggctctgttgtgggggccaccctgtgaatcacagggtgttcggcagcatctc

SEQ ID NO: 391606 - DNA, 4921 bp, Homo sapiens
ctgcagcttctaggacccggtttcttttactgatttaaaaacaaaacaaaaaaaaataaaaaagttgtgcctgaaatgaatcttgttttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 391607 - DNA, 4424 bp, Homo sapiens
  misc_feature (1)..(1): n is a, c, g, or t
  misc_feature (10)..(10): n is a, c, g, or t
nggatacagnctgacaagaagagtacagtgccatgagagaccgatacatgaggacaggcgaaggcttcctctgtgtattggccatcaataatagcaagtcatttgcggatattaacctctacagggatgcccaacgtggggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 391608 - DNA, 4867 bp, Homo sapiens
ctgcagcttctaggacccggtttcttttactgatttaaaaacaaaacaaaaaaaaataaaaaagttgtgcctgaaatgaatcttgttttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtatgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 391609 - DNA, 2803 bp, Homo sapiens
ccggaattcccgggatccacccaggccgtaaaattattaagtgaaattattcatatgcttgcagttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 391610 - DNA, 1315 bp, Homo sapiens
  misc_feature (76)..(76): n is a, c, g, or t
taactcattgtggtttgattgcatttatctgattagtaatgtgagcattttttcatgttgttaaccgcttgtatgntgtcttttgagaagtgtctgttcaagtctttggcatttttttcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 391611 - DNA, 2437 bp, Homo sapiens
ctgcagcttctaggacccggtttcttttactgatttaaaaacaaaacaaaaaaaaataaaaaagttgtgcctgaaatgaatcttgttttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcact

SEQ ID NO: 391612 - DNA, 4867 bp, Homo sapiens
ctgcagcttctaggacccggtttcttttactgatttaaaaacaaaacaaaaaaaaataaaaaagttgtgcctgaaatgaatcttgttttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatgggccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 391613 - DNA, 5478 bp, Homo sapiens
ctgcagcttctaggacccggtttcttttactgatttaaaaacaaaacaaaaaaaaataaaaaagttgtgcctgaaatgaatcttgttttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaccttttggcccccttggcccaagccatttttaacttgggccaattttttccttgcgccccaatttggggctaattggcccaattccccttaaagggggccgtttaaaaataaatggcccggcttttaaaaacgtcggacttggaaaacccttggggttcccaaattaaatccctttgaaaaaaatccccttttcccaagttggctaaataccaaaaggccccgaccgaatggcctttccaaacagtggccaatcctaaatggcaaagggaaatttgagccttaaaaatttggtaaaaattcccgtaaaatttttggaaaaaccacttattttttaaccaaatgggccaaaatgggatcctttttaaattaaaggatttcccggaaataggtttaagggttttcccattttggaacaagggcccccttttaaagagaacgggccctcccttggggg

SEQ ID NO: 391614 - DNA, 573 bp, Homo sapiens
tcctgggtagctgggattacagacacccaccatcacgcccggctaatttttgtatttttagtagagacgaggtttcgccatgttggccaggctggtctcgaactcctgacctcaggtcacccatctgcctcagccgcccaaagtgctgggattacaggtgtgagccaccacacttggcccaggtatcttttaaagagatttaagtaatgagagaaaatacacagttaccatttctggtactcttcattcctttgtgtaaatctaaatttttatttgctgtcattttacttctgcctgaaggactttctgtaacatttcttctagttgatgatgaattattatatgtctgcaaatgtcttcattgtgtctttgcttttaaaggtgtttttgctggatttttctccacagtgctttaaatatgtttctctgttgtcttcctgcttacatttttttctaagagaaatctgatctcatactcatgtttgttcccctatatataacatgtctttttttcttccccccttattgttttaaactttttatcactagttttggacaatttgattgcaatat

SEQ ID NO: 391615 - DNA, 208 bp, Homo sapiens
cctaagcaggtaatttccctgagccctgccacctcatctgaaaaacagagatggtaacactgctttgccctaaacttaccatgttattattttgcttttcttttcttttcttttttttttatttgagatggagtcttgctctgtcacccaggctggagtgcagtggtgtgatctcagctcacttcaagctctgcctcccaggttcaca

SEQ ID NO: 391616 - DNA, 701 bp, Homo sapiens
agcatcaaaagtttgcgagtcatgaatgttaaaaaagtttaactaatacaaatattcctgaagctgtccttatgtgaatgcatttttaaatgcatttttaaaacattacatccatagctacatttgcatcagaatgtaagatagtatgtgtaaactttacaacatgcaaagtatgctgtttattttgcaaatagcacatctcatgcttgcaattttattctctgattttctttctcctcaagagaaacccctcaacttttgttcataaaatttacgatttttgtctcctcactccccttaccactgaatatttcctgtgtgtctttttttctaaactctagtagctttatattttcagtgtcatctttatggaaaggaaatttcagaaaacgtagacacttggcactaaactcaaatgtcacagttcatttcaaatgttacctcctccataaaacctttggatccttttcatttggaattaatctccctatcatttctgcctttcagatttgttatttctgttatggcaatttacttcaacacaggggtacatggacctgagtgtgcaaatatattctccacagggagaaagagggctaaaatttcaatgttaatataaaataaatcagtatgagcatattcttagatcatgtggtatgccatgcctaccttacaaccagttactaccatgtattttcagg

SEQ ID NO: 391617 - DNA, 361 bp, Homo sapiens
attgatcagatgactaagatgatgtgaccagaggcctgcaggaacctagccctcaattttccactaggagccatgcctcagaattcgccagttcaatgtttcccacaactttataaaacataactcctgtgaaatcaggagaatcaatgctattacattaaaggtagaatatgggactaggtgagaatctccaagtgggaggggcaggtccagatagtgaaagaggctcttatgtcctaccaaggaaggtggacttctaattgcttctaacatgtagttactgattcaaagactatgggcttgggaagggtctgtataccttcctcctctttatggaatccctggtatctgtaaacaagga

SEQ ID NO: 391618 - DNA, 1107 bp, Homo sapiens
cccaaagagaccattcatatcaagacccaagccatgagaaaatgctacaatgcccttgattaatactttataggcattttgacctcagatctaatcccatgaggcttagaccaagaccttgcttgatgcagacctctctgactgctgaaattggtcaggagctcagtgatgaaaatttggaaagtcaatgctgatacctgaagaaagtcccatcagagatctgtgacctgaatcttcataactttcacaggccctttctaaatgccaaggaggatgtgtgtggagaagaatatgccacctatggcatcccaatatgcctgtgcccgcctgctcttcaacaagggaatgaaacctgggtattctcataggttttttaaagcacttgtccacatattttattccgcaaataacacaatttaaaattcagctagaatttgccattttctgtcagggttgtgcatttcttccagtcaccatgacttcctgagatagccaaaacacaaaatttaaattgtgtttaaattaaataaacacaatttatgctgaagctgactttacccactctgttccaacattacttatcctcagcatctctgaattcaaatatcagccaggtgtggtggctcatacctgtaagcccagcactttggcaagccaagatgggaaggttgcttgaggagttggagaccagcctgggcaacatagcaagacccccatctctacaaaaaaattaaaaaattagccaggcatggtggtatgcacctttagtcctagctacttgggaggctgaggtgagaagatcacttgagcccaggagcttgaggtggcagtgagtcatgatcataccactgcactgtagcctgagcaacagagcaagaccccatcccttaaaaaaaatacctgccctctgtacttcatagcacctggggcattttgaacagttcttccttcacctgaggtcattatttgagaatccaattttagagactacaatgctctcattacttggattgtatcatttaatcttcccaacaatccaggaaggggagtctcttaatgattgtccttgatttccagttaaaaaatctagacccagaggtaaccttg

SEQ ID NO: 391619 - DNA, 578 bp, Homo sapiens
atagcaacaacaaaacatagattgagcatccctaatccaaaaacctgaagtccaaaatgctccaaaatttgaaactctttgagcatggacatgacaccacagataaccacataggcaactgagatagtgacacctttgctttctgctggttcagagtacacaaaccttacttgatgcacaaaattttttttatactgtataaaattatcttcaggctatgtgtataagttggatatgaaacaagtgaatttcgtgtttagacttgggtctcatccccaagatatctaattatgcgtatgcacatattccaaaatctgaaatgtttctggtcccaagcattttgcatgaggaatactcaaactataattaaattcctaaggatttacttccttaaaaacgttgttaaaaacctatgtgaagcaggctatataaaacattcccaaaagacacaaagcagacttgaacaaatggaaagacatccactgtccttgagacatatcaaaatgtcactttttccaaagttaattagaaatttaatgagatcataatataaaaagactgataactttttggtatag

SEQ ID NO: 391620 - DNA, 438 bp, Homo sapiens
tggcatgatctcagctcactgcaacatccatctcccagtttcaagcatttctcctgcctcagcctcccaagtagctgggattataggtgtgtgccaccacgcccagctaatttttgtatttttagtagagacgaggtttcacaatgttggccagggtggaataaatggagttcagtactgtttgaagttccaggcatccaatgggggtcttgggacatcttccccatggatacggggattccagtgtgttctgtctctggtgctgagcaccaaggctctgtgtcctccatttctgagggattacatgagcctgggatccatagagaggagaggaggggctgtgctctgcatggggtttggtcagggctgggtctggccctgaaggggagcttagaccaggccagctccccactgctgcagcgtgcgtgtgggcatctc

SEQ ID NO: 391621 - DNA, 229 bp, Homo sapiens
gcacgagatatagtcatctagtagaatatagtgaattaactcagatctacatgtattaacatgaataaattctaaaagtgtaacactcattagaaaaagtaagtggctaggctgggcacagttgctcacacctataatcccagcactttgggaggccgaggcagtgggatcacttgaacccaggagtttaagaccagcatgggcagcatagtgagacctcatctctttg

SEQ ID NO: 391622 - DNA, 164 bp, Homo sapiens
ctttgtactgacgcaggctcttccttccctcagacaccagccctacatgctgtattccctgggggcagactccctggctcacttctcaccatttccagaccctcctggcatcatgacatttcattccttcattcattcattcaggccagtacttgcttctaaat

SEQ ID NO: 391623 - DNA, 256 bp, Homo sapiens
gctcgagttgttaggaaactttcactttgtggcagccactagcaggcaccttgcagcactccagctgccgggagagcagctgcccatgggcccagctgcagccaggcctcccacgggctgctcccagccagaggttgtactgacccagattccatggcagatgcaggactcctctgatggcacaaaataaaggactcctagggctttgaggaagctttcttagactgctgggtacctctccagcccttgggctggg

SEQ ID NO: 391624 - DNA, 273 bp, Homo sapiens
tattacaatcccgctgactagtcctgaaatcatacccactcagcttgaccccaagagccaagtatcatacaatagggaaatgttggcagagaaccatacagaatgagactctactgctgacctgtggtgcctaaaacattcacaaacgacagtagcaacccctttgtacattaatcaccactggaaaaaagcagtatctagagagttaagtttaaactatggttaggctagacactatacatttttacctttaaggaaacacactcactcagg

SEQ ID NO: 391625 - DNA, 254 bp, Homo sapiens
agggaagttgtccagatgtgtttctgagagaatggaggtacttttcactggtattgcacagtgatagaactttctgtgatgttggaaataccgtctatctccactgtccagtttggtcaccactaaccacatgcgacttttgacatttgaaatgtggctagtgcaactgaggagctgatgttttaattttgtttttgttttaattaattacatttaattaatttagtttttatttttatttatttatttatttt

SEQ ID NO: 391626 - DNA, 587 bp, Homo sapiens
tcggtctacctgtattcccagcactttgggagaccaaggcagggaatcacctgaggtcaggagtttaaggccagcctggccaagatggtgaaaccccgtctctactaacaatacaaaaaatcataataataaaataaaatagccaggtgtggtggcgggcacctataatccccgctattcaggaggctgaggcagataattgcttgaacccaggaggcagagatttcagtgagctgagatcacgccactgcactccagcctgggtggcagagtgagactctgtctgaaaacaaacaaacaaacaaacaaaaaacacttctttacaagactttggtattcatacttcaaaattttgtcattaattttgcttgtctacagaaatttgatttttttttttttctgtaaaccagatgatatgggttaggttagggtctaactggaatatgaaggaaggagtagataacaaggccattttgaagaataaacaacaaaattaataactgataagactcaaagagaagagggaaataacctaatggtgtccaattcaggtgtctaaaactacctaacagaaagagtggagctga

SEQ ID NO: 391627 - DNA, 282 bp, Homo sapiens
agccacccacctatgtgctatttagcattctgaatattctgtctacaccagggacagcaaatacaggcactaacgccatcactactcctactcataacaataaacactgctcaatgatcacagtatcctttcccactaatccagaagctgcgtccaactaacttctcaatgcagtcttccaggcagtcttcactatcaatcaaagctagcccatgaaataaaacctacttgccatatctagtccccactatattaatctgtttgcctcgatatatttgccat

SEQ ID NO: 391628 - DNA, 310 bp, Homo sapiens
gccctgaggctgcactgtggcagtctaggtgagagacgatggtgacaatgtgtggaggacataggccagagaattttcttcaccaagtcttgacagaatttggtgaagaactagctggagaaggcaagagtgaaggtgacattgtcacttggattttagggttggacatttagagtaactccttagtttccttttaactctcagatactgtgatttgatcaaattccaaattatgacaggtatctttcggatgagaggataaaatttcctttggaaagaacccatggatgaaggctgccaggacacaggg

SEQ ID NO: 391629 - DNA, 384 bp, Homo sapiens
gagacaagggagatgcatctgggtctgcagagggaagtgctagaaagggagtccctaccacacaattgggctttttctgaatcaaaagcagaggttgcaaatgggtggcccacaggttgaatttggtggaaagacaggtgttatctgactttctaggcactttacagagttcaattagttcacaacatggaagatctgaattttggccttctcttaaaaactcaagagcgttatggagcccacctcgtcacatggcaggtctggaggagctgagtggcggtggcctcttctggggaggcacgtgcttccaactgctccccaacactgaggctgggtgtcagttgccatctcagagagccggaattccccagagagccggaattc

SEQ ID NO: 391630 - DNA, 371 bp, Homo sapiens
tctgcacttcctgaatccatttcctattcattcttcagtccgctacagtctgactttgactttcacaagtgcaccaagtttgttctccctcagggtctccagttgctgtggtctgaatttgttccccaaagttcatgtgatggcacagtgttgggcagtgagactttaggaggtaattagggcaagaggactctgccctcgtaaatggattgatgctattatctttaaagtgggttaattatcatgggagtgggctcctgataaaaggatgagtttggcccccttctgccctctgtcttgtgagctctcttgtacttctgccttccaccatgggacgatgcagcaggaaggtctcaccagatgctagcacc

SEQ ID NO: 391631 - DNA, 537 bp, Homo sapiens
gcttgggccggggaggcacaggctgcagtgagccaagattgtgccactacgctccagcctgggcagcagagccagacactgtctcaaaaaaaagtgacaatgggacatcgaaatggatgtgctttagcaggcaggtaaaaatgtgggactgagctcagttgtgaagtctaagcaacatgtttatatttgggcatcacttgaatgggagtgactgctgataccctgatagtgaatgaagtctaaggaaagcaagtttacagagagagtcaaaagactgagaccctgagtctactttgtcagccgcagagtatcccagcattgaagaagcacccgaggtgagctcagcatgggtagaggaagagaaaccagaatggacagatggtgaggaggggtggtagagagcattgtccacttttaaaagatttgttgaaatagagcagtagcttttgggccggagctggctatatccagcaaagattttgcaggaaaaaagtttccaggagagaagatcattttttattgcagagcagtcagaat

SEQ ID NO: 391632 - DNA, 329 bp, Homo sapiens
atccatcaatagctgagtggatacatagaatgtggtgtgtccatacgatgcggcactagtcagccttaaaaggaagggaattctgacatgctgtaagacattgaagacatcatgctgagtaaaataagccaggcagaaaaggtcaaacactatatgatttcattcataggaggtacgtaaaatagcctaattcatacagagagaaagtagaaaggtagttgccagggcctgggggaggaggaaaggaggagtcactgtttaatgaatacagtttcagttcttcaaaatggaaaaagtcctgtgggtggagggtggtgacggttgtaaca

SEQ ID NO: 391633 - DNA, 185 bp, Homo sapiens
agttgtggcacctgtattcttttaaatccctgatggaggcaatgtgacaaagcagaaagtcaggcagacgaggattctaaatgtagctctggactacgtatgtgacattttaattattaaaactccctgatgctcaatttcttcatctggtaatcagtatgatgctgcctttgcatgattattga

SEQ ID NO: 391634 - DNA, 238 bp, Homo sapiens
ataatcacaatctccttacaaattggtatagaaaaaagtagattaggttctaattttggctgagattaggtacctgatcttattagggcttgatttcctcatcggcaagcgtaaaggtgaatgatacaatcttttagtcactttcaactctcaaaatcttattccatcccatatccagtttaatacccaagcccatgtcatctctcctctaaaacaatcaggaaaatgagtacttcaa

SEQ ID NO: 391635 - DNA, 324 bp, Homo sapiens
tacattagatctctaggcgtgtttattctacccgtctgttactttgtatcctttgagctacatctctccgttcgtctcacctacattcatgttcgtactttttatgtcccttcccctcccaagcataatataaaccgccaagagccaggaactctttttttaatttcatttttattaaaaaaaaataatgcccctctatgcctagcatggaactaatgcagaatgtacccatgtagtgtattgtcactgaatgaataatttagtctgagtaagtctatatccccaggactgattttgtggatgccagccatctcttcttggatt

SEQ ID NO: 391636 - DNA, 554 bp, Homo sapiens
gcctctgccccagagctgggcatcttggggtgcacagaggaggtgctgcatgagtgagaaagacttagtgaggagagaagcagggagggaaggaagtgggtggcagtggaaacagcactttcccagttgttctttcagccgatgttcattcagggctcatggtagccaggccttttccaagctattccatggattagccatcgctatgaattctcaggatccctgcaggaaatgccactgttgtccatgtcacagatgagaaaattgagatgcagacttagagtatctcatccagtggcatgcaagtggtgtggtacggagcacccacgcctggcctgcaggtgcctgcccctctccacccctgtccagtgatgagcgagctcatggcaggcatgcaggcaccctgggctcctttgcacacactccctcgcttgggcctgcggtggctccaggaagcaggtgctcttgtcatccccaatttgtagatgaggaaaccacaggcctctccagttggccacgcctctgaagttggtctgggtcacatgcctccgtgg

SEQ ID NO: 391637 - DNA, 373 bp, Homo sapiens
tggtctctgggtgaaagcgaggctttctatgcccatgtactgcctaaccccctcccctgagttgagctgggctccattatgacctggggctcaggcagaaaagcatttgaccggaggaggcggtccgcactcagcgcctcctccagagcctccagagccgaggctgactgcagcctggggagagtggaggcagcacagctggaggtggaactgaggaaggactgggcggggcatggagcaggcccccttctccggcccctcctcccactgtcctctgcccctacttgtcctgctctctgtctgtggggtctccgtgtctctgcccctttttcttgagtttccgtctttgccactttctcttacctctcagtcc

SEQ ID NO: 391638 - DNA, 426 bp, Homo sapiens
tcctatttacatgtgagagcatgtgatgaattgttgctgcatccaagatatgagagattcttttttattaggtgagcattatttataaactttgttatgaaaatgtaaggacattaaaatgtaagatgcatgatgaaaatctaagtgaagagacctttgtggttaacttataatattgagtaatgtgtgagttaagtgttcagtcatattcttctgtattatgagaagaaaacatttttaatttcataagtaaattaaaatttagtatattgtactaattatacttttatataaaatgcagtatattttgaaaatttcagattatatgtgatgttaatatattcaacatctttaacattttaaatactgttgtgcattcagtgaagtgttatgtaacaaacattaattcccccttactcaaggttg

SEQ ID NO: 391639 - DNA, 769 bp, Homo sapiens
agccagttggtgctgcagtctatttcctctggatcagggggtctcctcagtagagtccctttgtggttcaccaggaagatgttagtggaaaggggtcccaatccagaccccaaaagagggttcttggatctcacacaagaaagaattcagggcgagtccacagagtaaagtgaaagtttattgagaaaataaagggataaagaatggctactccattggcacagcagccagaagcaagaagttctgaactgcctatcagatattaccattttataaatgagaaccagtccataattttggaacatgtttcctatataataaccctttcttagttggaaatgacccagacattcaacaagcatctacaatgattttaagaacttaaatcatacaaaaaagttttacttagaagcatttatctcatttatatgcatataattctcccatttttaaccgtttacttagattacttctgaaaactgagatcttaccacagaggtagtcattattgaaagttaattccctgttaaccattttaaagcttgtgaacatcatgtgttcatctaagtaagaaccttaaagttaaaacacataggcattttgttgataactcagaaggtttagctattttcctcaaacaatattaaatgtcttatcaaaaattacacaaagatcattctgtcttgggctgggtttatagttttgtaactcttatgccaaattttggcacctaatgatatctggcagagataaatatgaaaccgcttga

SEQ ID NO: 391640 - DNA, 280 bp, Homo sapiens
tgcctgtagtcccagccacttaggaggctgaggtgaaaaaattgtttgaggccaggaggtcgaggctgcagtgagctgtgatcataccactatactctagcctgggtgacatagtgaaacctgtctctttaaaaagaaataaagtttaaatgttttaagtaaaacattttaaaagattttattatttaaacatatcaataataaaaccattgcatattaacctaatataattctatgaaaaataactataaaaatttttgtgaaaagaatgacattgatt

SEQ ID NO: 391641 - DNA, 908 bp, Homo sapiens
gaaacttaaaaactcattattgagttctctttcccatcttgcaagatggtgagaagttggatactgaggagaagaaacccgaagccaagaaggctgatgctggtggcaaggtgaaaagggggaacctcaaagctaaaaagcccaagggggaagccccattgaagctgaaatcccatccttgtcagaggaattggcagatattcccaatctgctacatattccagaaaggccgtgtacaagaggaagtactcagctgctaaatccaaggttgaaaagaaaaaggaggagaaggttcttgcaactgttacaaacagttggtggtgacaagaatggtggtacccggctggttcaacttcacaaaatgcctagatattctcctactgaagacatgccttggaagctattgagccatggcaaaaaccccttcagccagcatgggagaaaattgtaagccagcatcacccctgggaccttctgatcatcctcactggacaccacagaggcaagagggcggttctcctgaagagctgggcagtggctgttacttgtgtctggacctctggtcctcagttgaggacacaccagaaatttgccattgccacctcaaccaaaattggtatcagcaatgtgaaaatcccaatacatcttactgatgcttaattcaagcagcagcagctgcagaaccccagacaccagaaaggtgagctcttcgacacacaaacagagaagtacaagattacagggcagcgcaaggttgatcatcaaaaagctgtggactcacaaattttactgagtatcaaagctattcctcagctccagggctacctgagatctgtgtttgccctgatgagtggagtttatccctcacaaactggtgttctaaatttcttaagaacctaataaaggat

SEQ ID NO: 391642 - DNA, 234 bp, Homo sapiens
ggggtacggtgtttagggcccagagagggttggaatcacgatgcccccagttgtccttacctctgtcccggacttggcactggacccgccagggggcctttggtgagggtttgctgaggaagctgaaggagggcccgcgtgcagcatagtgctggctcgtctgtggatggccacgctgagttggcgcacataaggggcagctgctgctgcggggccttcaaggtgctatccttg

SEQ ID NO: 391643 - DNA, 203 bp, Homo sapiens
cagagctgcagctggagtggtggcatcaggaggctaaagacttgcttctgagttagaaggtccacagcatgcaggccgtgcactgccaagagcagggcagaagggttctagctaaagaggttgtttcctctgccaaggttctaagcagcccaggaaaaaccctttggcttctctgagccttggttctctgggaaaaacagagg

SEQ ID NO: 391644 - DNA, 398 bp, Homo sapiens
ccctgccctgatgcagggatcaaggaaggtaacatcctgtgcctgggacgcctgcttcctccctcttgcatgcttcagtggttaagagtaggagcttgaatttagagtcacacagacacagccacttactggctgatgatctggcaatttacctgcccaaagcctcagtttctttatctgtaaaatgaagtttaatagccccaaaccttacaggattattttgaggattagagatgctgcttccaagctcttagggcaatgatgggcatgtgattggattatatgattttatccgccagtcccccacttcctgataatttttgagtacttctaggcgcagggtctgtatcttaccatcttgtctttcccagagcctaccctagcaaagcacctagcac

SEQ ID NO: 391645 - DNA, 311 bp, Homo sapiens
agggctgtaagactgggaaactaaaggagtgtgtatgtgatgacctcgccatgtgtgtgtatgcgtgcatgtggggggaccatgggagtgtctgatcctgaaagtgtatatgggagtgtgtgatttttgtgactatgggattgtgtgttttatatctgtgtcactatggcagtatggcctatgtatgtgagattttatggctgtaggtggtattttgggttgaattgtgctcctccccaaaaaagatatattgaagtcctaaccccagaacctccgaatatgattttatttggaaccagtatcattgcaga

SEQ ID NO: 391646 - DNA, 462 bp, Homo sapiens
atgaatccaacaaatgcactttcttcacagatcaaagcataaactctaattgaagactataaaaggcacatgcagtgttcatggcaccatagccatggatgaaaagactcatcattgtggagattggcagttctcaaattaatctggatttattaatacacttttgattatattcccaggagagatttttataaaatgcagaccagccaaggcaatattgaagaggcgcagacggcattaagaagctgcaattgcagggcagccaggccaagaggcaccagggccctcagcgcagcagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgta

SEQ ID NO: 391647 - DNA, 310 bp, Homo sapiens
aggcgtgagccaccgcgcccggccttgtttttgtttttaaataaacattttcttttaggacagtttgagatgtataggaaagcgacgaggataccccagagttctcacacatccgcagtctgcttccccagctgctagtatcttagtctgtgggctgcgtttgtcacaacttgtgaaccaatattgatacatgattgccgaagtccacattttattaggtttctttaggttttccgtgatgtcctttttctgtcccgggatcccatccaggatccccacagtacctgtagtcacgtctcccaaaacttcc

SEQ ID NO: 391648 - DNA, 1034 bp, Homo sapiens
acagagggctttgaggtcgcaacgtcccggttgctgagcggagtcaggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcgagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctcatgcctggggtcggcccggcgggggtgaccccgcgccctcgccggtgcaaggagaacagctggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgagtcgcttgagtcgcggttgaatgcacatctgtgcaaaaatgtgatgtcaagcgctatgactcattgacagagtgtctcagtatttcctgcgttgtgacttgagatgagttattagctcacattagtatgttatcagactagcgtttagtgttgtctactcatcaccatctactatacacagctgattttagatttggtacactgggaacaacatgcataa

SEQ ID NO: 391649 - DNA, 664 bp, Homo sapiens
  misc_feature (27)..(27): n is a, c, g, or t
  misc_feature (40)..(40): n is a, c, g, or t
  misc_feature (42)..(43): n is a, c, g, or t
  misc_feature (45)..(45): n is a, c, g, or t
aacataggctaggtacgggctggtgtnaatcggccgaggntnngnggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcagggaggtgggctcagggtttctccagagaatccccatgagctgacccgcagggcggccgggccagtaggcaccgggcccccgcggtgacctgcggacccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacatagacttctttatatcttttgagctccctcccttttattatgtaatgaatatgtgttgcttttgtaataggaaaatataaagttaaaatttca

SEQ ID NO: 391650 - DNA, 736 bp, Homo sapiens
  misc_feature (27)..(27): n is a, c, g, or t
  misc_feature (40)..(40): n is a, c, g, or t
  misc_feature (42)..(43): n is a, c, g, or t
  misc_feature (45)..(45): n is a, c, g, or t
aacataggctaggtacgggctggtgtnaatcggccgaggntnngngggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaaatgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagagttgcttgaacccgggaggcggaggttgcagtga

SEQ ID NO: 391651 - DNA, 2040 bp, Homo sapiens
acagagggctttgaggtcgcaacgtcccggttgctgagcggagtcaggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcgagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctcatgcctggggtcggcccggcgggggtgaccccgcgccctcgccggtgcaaggagaacagctggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcagggaggtgggctcagggtttctccagagaatccccatgagctgacccgcagggcggccgggccagtaggcaccgggcccccgcggtgacctgcggacccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaaatgcacccttcctctggctggtgtctcccttctgccaagctatgcctcctgcagaggtaggctccgtggtgtctcccactccgccccaactggagaacggtgtaaagaactgtcagccgggtgcagtggctcacgcctgtaatctcagcactttgtgaggccgagaggggcggatcacttgaggtcagaagttcaaaaccagcctggccaacatggtgaaaccccgtctctgctacaaaaattagccaggcgtgatggtggatgcctgtaatcccagctactcaggaggctgaggcaggagagttgcttgaacccgggaggcggaggttgcagtga

SEQ ID NO: 391652 - DNA, 1842 bp, Homo sapiens
acagagggctttgaggtcgcaacgtcccggttgctgagcggagtcaggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaggcgcgagacccggaaaacaaggaagaagcgagctcagcctcaatccccgtccccaccccactttcgggaccgctaagctggagaattgaagggggcggaccccggattaaagccgctcccttcccagcctcgccccgctttcctaatgtccgtgatgatttcgttattggcagggaagagccagactccctgcgctcccaagacggggcgattgggagggggttctggagctcatgcctggggtcggcccggcgggggtgaccccgcgccctcgccggtgcaaggagaacagctggttcccgccggggcagggaagcgtggacggtgtgggctcaggcgcctggcaggcacacggggcctctaaagcttggtcactgtcacagatcgtgtggttgtttcttccgtccccgccacgccttcctcctgggatggggattcattccctagcaggtgtcggagaactggcgcccttgcagggtaggcgccccggagcctgaggcgggaactttaaaatcagacgcttgggggccgggctgggaaaaactggcggaaaatattataactgaactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcagggaggtgggctcagggtttctccagagaatccccatgagctgacccgcagggcggccgggccagtaggcaccgggcccccgcggtgacctgcggacccgaagctggagcagccactgcaaatgctgcgctgaccccaaatgctgtgtcctttaaatgttttaattaagaataattaataggtccgggtgtggaggctcaagccttaatccccagcacctggcgaggccgaggagggaggatcccttgagcccagaggttcgagactagcctgggcaacacagtcagactccatccttccaaaacaaacaaacgaaaataaaacaaacagaaaacgaaattagccgggtgtggtggtgcgggcctgtggtcccagctcctcgggaggctgaggcaggaagatggcttgcgactgcaccactgcattccagccttcgcgacagagcaagaccctgtctcgaaaaatgtgtatgtctgggtaagtgtatagattttacaactattttgaaggcgacctttttaactttaaacagaccactctggaggagacgcctgacccagagcgctttacctaaagttcggtgcctaaaatgcacccttcctctggctggtgtctcccttctgccaagctatgcctcctgcagaggtaggctccgtggtgtctcccactgcacccggctgacagttctttacaccgttctccagttggggcggagtgggaggtcgac

SEQ ID NO: 391653 - DNA, 776 bp, Homo sapiens
gagcagtggttatagggttggccatataatttggtcattccagttcctatgtttctggaccaagaggaacaatgcctggatttgataaatgtcttgatggaatagaactttgggttatttcccttaagaaggtgtggaataaagggagcaaaggaatgtttgccagccagaagaacagactgtggcagaggctggggctcaccactatgctgaagtctgctctccccacatttccgagtttccttacaaattaagcaagtctatggctagctttgtcaatgcactctaagcagaagtcatgtgtgtcacttccaagcaaagaagagccatccatgcacatcacttggctttctctttccgacaaagtgacccgcaactatctagatggtgggacctcgtcagctttggtctcacagtagcaatcctgacttgccctgaacccccaagggatgaaaggtcaggttattttaccaagtaagtaacctcagactagcagaagtactagccaagggtggaggtgaatctagaataagtagtagagcagagagatgagtaccaatcgtggcctcaagaccacctgcaaaaaacttaaatgcgtatccccactctagagtttcccaaagagcccaagccaagataaagggagattcttcataatagataacagaccccagtagatctcattagctccactttatcacattaagaaattttctacagatgtacttcatttttaccactttatgtactgatactaagggagtaagttagaatat

SEQ ID NO: 391654 - DNA, 827 bp, Homo sapiens
tacattcaaggtatacgtttttccttgaaaaaagtgtaagttttttgaaaagcaagtaggtaattcaactgtaaaattgcttcatgctgttccttttttcctgttgtttgtgtaaaagcatgtcatcaatttctgttgcatcagaaatctgagagattcctttcttattaggtaggcatcattcattaatttttccatggaagagtaaggatattaaaatgtaagatgataatgaaaatctgattggagaggctctttatggctgacttttaacattgttcatgtgatgcatgagttatgtgtttagagtaatattctgcattatagtgagaggaaaactttgagttttagtagtaaattgttttaccaattgtacttttatgtaataaaatgtagggaattttaaaattcttttataagactgtgataacttaacttttaaattaaacgaaatggttttaaactttttaagacgtgcatttagtaaagtgttatgtcaccaactttaacgtatcccactgtattaaagatgtagataaaagatggtaacatagtagaatgacctctctagcaatctcttttgcctgtggcattaaactgaaaagtttaacagtattgtttcaatgggtaaaatgtacatttgtttaactttttaaatttttgtaggaacataatattgtttacctatttatggcatatatagaatattttcatacaggcatacaatttgtaatcacatcagagtaaatgaggtattcattacctaatgcattttttttgtattacagacaatccatttaaacatttttagttatctaaaaatgtac

SEQ ID NO: 391655 - DNA, 267 bp, Homo sapiens
atacttttttaccttctggaatggcagggtacgtgagtctcatcttatgcttttcctgccctttccccggaatcagccatttcttccaggtgccctgggcccttttgaggagagctattagaaaccagggtctgcagccaggcgcggtggctcacgcctgtaatcccagcactttgggaggccgaggcaggcggatcatgaggtcgggagatcgagaccatcctggctaacacggtgaaaccccatctctactaaaaatacaaaaaa

SEQ ID NO: 391656 - DNA, 365 bp, Homo sapiens
tcagtgcaaagtcaacagttcctgggattttgagtagcactcaatggttctatagatgcagggtgagtaagcaggcatactgtcgcttggtggcaagcactttgtatgcatatatctcactattaacaagtatatgtattagcgccaggtggctcacatatccacaaatacacaggtgacacagcccagcatgcgagtgcaagacagttttgtgtttgcacaagactaagaggtccttgtatgtagattctgtcttcttggacacttagttgttgagaaattttttgttgaattttaaaaactgagatgattttctagtcattcatttattccatgatcaagcctggcaattaacttggttgaat

SEQ ID NO: 391657 - DNA, 98 bp, Homo sapiens
tctgtaatcccagcacttagggaaactgaggcaggaggcgcgcttaaatccaggagttcaagatgcctggacaacacagcgagaaccccatcactacc

SEQ ID NO: 391658 - DNA, 420 bp, Homo sapiens
tcttgggtctgtgagtcaaagaaaaggtccctgtcccagggagtgacaggcagtaattaggctgagttgggtggggaggtttgtctcggcctccactgttcccggaaaccgctgttctccttggaacagccactgggagttggagtgtttatttgatttctgacttgctaagcctgtaatttacctgctggaacagacagagtccagctgcccaaaccgtgtcattaaaagcagatcctgggcccgccccatccacaggcacagcctggcagagtggttccacctccccatgggcccaaggatgcgcctctctggagttcacgtgctgcacccccagggaggggcctggggagagctggtccagcagcaggggtggaggctggggccacactgcgggacagcagcccctccacctggacc

SEQ ID NO: 391659 - DNA, 386 bp, Homo sapiens
cttttatgtaccccctcaatccacaccctcaacatcaccaaaagggaaaaagccatttacttcagaattaaacttgaagtggtgtggtcccttctgaacacccagtgctgccatgccaaacggggttcttccccaacctgggatgctacagttaagtacagcttggggcaagtttctagagcccaaagacctactttcagggtagcccagactggaagcaaactcttctagtcactggccagcaagccctgtctacgcaccatgagtgctaaatccagatataaggtcctttgtgtttgccccaagaagacatttctgtttacttaaatggatgcttccttaactgagaaacaaagtgaaagctatcaggttaaacatgccttgct

SEQ ID NO: 391660 - DNA, 322 bp, Homo sapiens
aattcttgaactccaagtcaactcctcgctttagacccttaaacaccatctctctgcccacacactggatgtccctctcttctaaggaaacttctcacattaggtgctgggatgtacggaggaaaaaaaaaaaaaaacccgggtgccagccagaaagaaaatgtagagccagttataaaaaagggtccatgggctgggtgcagtggctcacacctgtaaccccagcactttgggaggccaaggtgggcggaccaaggtcaggagattgagaccattctggctaacatggtgaaaccccatctctactgaaaatacaaaaatt

SEQ ID NO: 391661 - DNA, 592 bp, Homo sapiens
gaaaaaaatctcttggatggattcaagttttcatatctgcagaaggcatttctacagctattgtcaaacttagctggtctgtaaagattctttgtttctggttgactgttgcagaaagcaagttcataaactaccacgaatacaggagagaatgatttctattgaaagagtcgagtaggatatggtgcatggagccagtcctgaaaagggttttgtttcttgtagcatggtggaaattcacattcacattgctgctctgtgctctttagcatgctacagtgaaacaatgggcatgccagccgttatagcagtgttgattaatgcattccttgaatgtgttgattaatgtgttcctgggatgcctccttaagccgccactgcacctgaggtgtgttggatatgccttctccccggctgctgcttcgctcacatgagcccttttacacatgggtcttttgtgtgtatatttcacaccattgcctttatgaataaaatacagatctagcagactttttacagacatattatcatctgacagaagtgtctacattataatctagttgggactctataaactatgatgttcatagga

SEQ ID NO: 391662 - DNA, 281 bp, Homo sapiens
tacaggcacccaccaccacacccagctaatttttgtatttttagtagagatggagtttcaccatgttggccaggctggtctcaaactctcaatctcaagtgatctgcccgcctcagcctcacaaagtgctgggtttacagatgtgagccaccaaggccagcctatttactcttaaaactgaactgcctcggtctttttttttttccttcccttctgatgcccttcacaccatcatttgcttaaagtctttgatgtgtccattttatagattacgatgctgt

SEQ ID NO: 391663 - DNA, 292 bp, Homo sapiens
agctataaggctacgctgatctcacagcgagaacagccttaatgccaagctgttctgggaggcagaagttttcagcaatcgaaatgacaaggttcattctgagttttggaaatgtcacttggccctgctgtggcaaaccgacaggagttggattgccgaagaaagatgagggaaccagtgagaggatatcacaattgtccatgtgagacgtgtgccacaatgtgagtgataatggagatggagaagtcagaggaaaggccatttggtgggacttgatggctaacagatgtga

SEQ ID NO: 391664 - DNA, 439 bp, Homo sapiens
taacttaaaaactcaatgttagagctgtatttgttggtacagttgagtatgacatggcaacatttagactagcagttttaatttgatcttgtcagaattgatctatagtgcaaacgtagttatgcacatagctgaaactttgcggagaggtaagcaggtacactgatcagaattgttaggtaaataaccatagattcactcaggaagaattgtacaactctggatgcatttcagtgaagagaaaaagaaagggttctgatgagctttctttttgaaggaatagtcctttcacttctgatttttggagtatgagagtctgaggttgaagatactcttatatgtatgtaaagtctatagtcatctttcagctgagctggtctttgaattccaagtttaaaaagccagcaatttgccgttagctttcaatccagatctctga

SEQ ID NO: 391665 - DNA, 282 bp, Homo sapiens
gtccctctctggacctgtttgtttccccatttctaaactagagataagggttggaatgagaattaaatgagatttgtgaaaagcatttagcctggtgccaggcacttggaaaggtcacagaggaatgcgccccattgcacccaccatggctccacccagcacctgcactggcccaacccagaggggcctgacagctttctcccagtcactcgctctgctgggcaagtggagacccaagctcaggacatctggaagggtctatggattccccctcccagacag

SEQ ID NO: 391666 - DNA, 734 bp, Homo sapiens
cacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgag

SEQ ID NO: 391667 - DNA, 3122 bp, Homo sapiens
atctttactttgtgttgggagcattccagttcttctcttctaggtattttgaaatatacaataaattattactaacggtaaacaccctaccttaagttttcttctttaacatcttaatgtagtcaattatataaatatattctatttttaaacttgggtgagttaaaaacatatttgtctcaaaattctcttttgctgtctgaaatatccagattcatatctcgcgttgttgtctttgtgctaaccagcttctcagaaatattatttcacaacttcatggctttgcttagttggaggaattttggcacctggcttcttccttgctcagatccagagggcaggtagtgtttaagaaaacaggatttgcaattaggaagacctcagtttggattaggttcatccatttgatagttggtgaccgtggaccaagttacttctctgaatttcttttgcacagctataaatcaaggattataatccttcacaaaatcataagaatcaaagccaaataatgcatctaaaggtccagcccagggcttagcacactggtataacacaaactagctgttgttattataagtgtaaatcctgtggtatgcccctttatgacctgcagatgacattttccacttctactattgatcataggtaccttcatggttaagaacatgcattttttgtcattgcaattttattcccaaatctattcatgtattcagcagtgaaccgaatacccgttatatgccagataccttgctaggctgggctgtgggtgatacctgttccacaagacaaatgtgggctcaaagagacatgctctctgcccttgtaaagcttgcagggaagataggcaattgagtatttggtagataggaagtgttctgggaggcctctcatatagtatgtgagagctctcatataggggataaaggaagtcacacctcacaccaagacctgaagccacacacctggtgtagaaagggcggagagtcttctaggtggatggaatagcatgtggggaagagtttgtggtatttgaggagtagggaggagaccaggctgtccagagcagggcatagaagatgaattggaggctggacaggtataattatagggagactagcttgcaggtgtttatggagttaagatgagaaacaatggtggcctagaggagtagcagtagcaatgtagcaaagtggatagattctaaagatatttagcaggtagaattaatgcgtgatgtaaagaatgagagagagtcactcacaggctttattgagcaggtgggtagccacaagtttgaataagtgggtagatgagaagggaaacattggaggggaggagagggctggaggagtgttagatgctactgaggagataagcaaaataaagtctgaaaactgatcattaggcttagtaacctggaagtcactaatgaccccagaaagcaatttcctggcttccttcctaggagccagactgcaatggattgaagagggagcagaaggtgaggaaacagagtggtaactcagtcaagaggtttgggtgagaggggaggagacagagagggtgacaattggacaggggcaagagtccaaggaggcatttgggtgctctttttttttttttttgtctacttctgctttttattgtgagaagtttgggcttatggaaaggctaacaggatggcaccagtaaagaaagagacactgtgaacactggagagacacagtgatgtatagctaggtccttgggaagcaggtcacagagcacagctgaaaaattggaggacataatctccaatgtaattgaagaaaagaattgttggcttggggtgatttcttgctttgttttgtttggtggcaggaaattgaggctcttctctgaagttgcttctgtttttcccatgaggtgatagtaaaatcatcccccaagagtaaggaggcacatcggagagtcagacatttgaggatgggggagaatggagagctcattgataaataagacaatagaggtttgctgagcagggttgttgaactgctcataatcatgaacttggagtgatgctagtctctgtggttgtggtttactccagtattacctagcagaccaggggtagtcatgaagatggctgagccagggttggggtattgccaagttgatgtgatgaaaagacagtgtagcaaggagatgtagaatattggcaggagacttaatgaccagtttgagtgtctgttacgtcccttataaaaaaactatgggcatattgtagttggtgctggttagatttatttatttatttatttttaatttttttttaacccctggaagaaaagtgtcattacactggaggaatgcaatttggcaatgacctaagacagcgtttggtccctagaacagcagcattagcatcactagggaaattagaaagacagattctcagcttccaccctagatccactgaaccaaagactcgggctggggcccaacaatctgtgctttaacaagcacataaggtgattcagattagtgctaatatttctgaataattaatctaagagaaaagcctatgaatggtcaaaaagttggacattaacagtaatattaatgaaaataaatgtgagttctttaacattgggagcttgtctgtcttgtgtagcattcccaacactccgaacatctgggtcataagaggggcaaaacgtatgtggaatgaaggactgaatgagtttataaaatagtacaaagatgaaggagagctgggaggagcttccatataataatctacagtttacttgaaagctcattaaatctacctgtaccctaaaaaaaaaaaaaaaaaaaaagcaaaccatacctactacaaaagctagccaggtagatattttctggtctcattaatgtcttttgcaataagagcttttgttatgtctaaaagcttacacacactaaaaaaaaaaaaaagaaaacaaaagaaaagaaaaaaaaccaacctcaggccagacatggcatggtggctcacgcctgtaatcccaacaatttgggaggccaaggtgggaagatcagttgaggccaggagttgaagaccaacctgggcagcatagcaaggccctatctctgta

SEQ ID NO: 391668 - DNA, 246 bp, Homo sapiens
agtatttcttagtgttatacatcttttgctgggtatcagaggcttggtcctattttccctattccacattaaattttgttagagtaacagtagttcatttttggtgcagctttctcaagtgtcaagtacagttcttaagtactagctattctaaagctgacctgattgcttttcagtgttttgaccctgcagagacctaggtcaggtttagtagcttgtgaatcagataggagatggctcctgtta

SEQ ID NO: 391669 - DNA, 1080 bp, Homo sapiens
ggcgggcgggcgggcgggcgggcgaagctgggctcggggccaagcgaggtctagccggagcgactgtgccccgcctcctgggcggagcgggcggctccccatggtcagagcctcgtgccggctcggcagcgcccggacgccgagcccagcgcgtcggccccccggcgtgcgggcgtctcagagccgcggaggggccgccgggaccgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatcttaaaattgag

SEQ ID NO: 391670 - DNA, 239 bp, Homo sapiens
gtgatagaggttgaggccaagaagttaacgggaatcagattattagggccttatagccttaattattgtgaagtatttactcagagacaggaaactattagaaggttttgagcagaggaatgctgttacgtaatttagattcttttttttttttcttttttagggatgggatcttgctgtgttacccaggctggcatgcaatggagtgatcatagctcacggcagcctcaaacttccgg

SEQ ID NO: 391671 - DNA, 531 bp, Homo sapiens
ctactgtgctaattgcacctaaaatgcctgcacacatttctccaaatttaaaattctaattacgggttgacatctttaaacatcttggtgatataccctggagggggtggaaaatctgtgctgattttccctactgcatctgtaggtgaaaggatttgctggcatcccaaatccatggaacttaataaggacagaaaggtacttagtgctttcctggccctaacaccctacttatttaggagatgagaactcaagtggctattccaactctctctaggagccatccccaacttcctttcctatagcctagtctggatcagtggtttgtgttactcatctgtgcctggcacacagtaggacctcaaacaagtttgctgaatgatgagttatttgaggttacacacataggtagtgtcaaaactgtcctgactcctgatccaagactctaaacttctataaactgcccagactttggagtcaaaaagattctacttagagtcctagctctggcacttacaagatgtgttttta

SEQ ID NO: 391672 - DNA, 354 bp, Homo sapiens
acatggagaaaccccatctctactaaaaatacaaaattagccaggcatagtggcgcatggctgtagtcccagctactcgggaggctgaggcaggagaatcacttgaacccaggaggcggaggttacagtgagccaaggtcgtgccattgtactccagcctgggcaacaagagtgaaactccgtctcaaaaaaaaaaaaaaacagaggcatgatgacccaagagtacagcatggagatactcaagcaaaagtaaaaaggaaagcaaactgcagattaaggaagtatcttctgcttgtttgctaagagttttagtcacagatcaatgttgaattttatctaattttttaaaatttt

SEQ ID NO: 391673 - DNA, 716 bp, Homo sapiens
agcggaccagaagcagaggctggcaccatgttctgttatgcacgcctgcagaaccagaaatcatgggaaaaactgcccatttctgttttgtccactttgctttgggaagtgagagctatagtcattatcaccacatcccctggcatccaattccacattctacctcagaagattattctggaggaatccaaggcacgttagatattttaccaatgtctctggtgattcttatatcggtaggcccatgggtgttgacctatgaaactgctctgctagcagactattgagaaactagggagttcaggattactaattcaattccatgctttcctggaagccagaagtcaacaatatacattgggatttctataaatatttcttagttatgaccatcgaactccaagtacttcagattaggaacgtcggactgcttaccttgactcctcagacctgcatgatggcctattgtgggaccttgtgattatgtagtgagacgagcatgagtggagcaggagacggctgtcccccaccacaaggaatatcagatgatggttcagcgatcgtcacattgcctctactgaaagtgatagacatcggcagctggcaccagggagcaggcttatatcctgatggcccacaccgtgttgcactaagatgtgaatcgaatgccgattcccaggcagaaacaagttcctggtgcatgtgcggtaggagac

SEQ ID NO: 391674 - DNA, 262 bp, Homo sapiens
caaagacagaaagtagaaaagcatttactgaggctattcattgcaagaataaaggttattcgttccaagaaataagatgtttaacctgaatttaaactttgtacagcagggattccataagaaaacggaaaaatgaaaacccaaaagaattgcccagctaagcccagttaacccacagtcccatgagaaataataataacttgttgttggccgggcgcggtggctcacgcctgtaatcccagcactttgggaggccgaggcg

SEQ ID NO: 391675 - DNA, 422 bp, Homo sapiens
ctggctttgttttactccacttcactttgtttctaatgtgtaaattttcagatgcttttctgctagaaaattcctcttggtgaatatgatgtgcctatcctcacataattccacaagtggcatgcagaaaaacagggtgagtcccacaagaaccatccaaagctcttgccttcactctgtgtttgctgaacacccactctgtgccaagtaatgtgctggatggcaaggattcatggttgacattgaaagacaaggttcatatgtatatatgtgccatgctggtgtgctgcacccattaactcgtcatttagcattaggtatatctcctaatgttatccctcccctctccccccatatttaactaacctgcacattgtgcacatgtaccctaaaacttaaagtataataataattaaaaaaaa

SEQ ID NO: 391676 - DNA, 335 bp, Homo sapiens
aaaatatcctttaggaatgaaggcaaaattcagacattctcagatgaggaaacactaagagtgtccatcagcaacagacctgcccgaaaataatgtataaaggacgttgtctagacagaaagaatgtcaaagagaaggtttaaaagaaggaatcttgggacatcaggaagaaagaaagaatatggtaagcaaaaaatagaaataaataaaatacttttcttcaccacttcaggtttttaatgtttctttgatggtgaagcaaaaattataacattgtttcatcttggttctaaatggatctagaggaaatatttaagataactgtattttaaatg

SEQ ID NO: 391677 - DNA, 666 bp, Homo sapiens
ggtaccccagccggtggggagagggaatataggaggggatagttgaggccaagaggattggctccaaggaatccctggaatcagctactttgtcctctgggggtcttctacctgtaaacctcaggcgtcttggaaactagaggagagtaaagacttgagctgtggctccagctgagggacacattccacaggtgctgaagagcacgtgatcatcatctatgcctgcttagttagggctgctgttagcacctggattttacagatgaggaaactgagactcaagagggcttgtgaatttcagaaattcacacatgtcagtggcagatcagaaagaagcccatttccggcctccatgtttacctagatctaggcaaagaaccttgctttagtctctaacaaatttacctcagaagagagactcatttgttcagtttattcaaggtttggatagtagatatgaagagaaatattgaaggggaagggaattctcagcttagcatacaggggttaggaagctaaattcagcccagggtgatagaagtcacgcttgcaactgggtggtgcagcaaggctggggatgcagcaccgtggacagtggcaagtctcttagctcctccgagtccgctggctgtcccagctaggaagcaaggacaccaggtccccccc

SEQ ID NO: 391678 - DNA, 260 bp, Homo sapiens
gttagagaatttgagcaggagagtaatatgaactatttggatagaaagtgcttggttcacttttgggagaatggatttaaagtatgtgggaatcagcaggccaaggtaggagacagggtagttcaagagagagacgatgagagcttggagtacggtgaaggcaatgaatgtggagagtagacgatttgtgattcattttgactaaagtccaccatgtttgccaaaggtttggatatgggaaattaagaaaggggcttagg

SEQ ID NO: 391679 - DNA, 637 bp, Homo sapiens
atgtctaaaggatgcacgtgtctaaaccacttcccacctttggtgctggttttgacaggctttctgacatcccagagatccacgtaagaaatttagagagaaaaatgttcatcctcatagcatttattgaacttaacatggctttatgtactctggtaagtgaattgcaaatttagaatgctgggctcattctcatttcttcttaatcaccatgagtcattccttcactaacattgaaaggcctatcaggttagatatctatatacacacagagcgtgattgtcagagaaatacttgcactgcatttctaggccacataatctttagcctaacatttgcatattaatgcataattgtaaaacattatgtaaattatacatggtggtgaatatattatcaaatcaaatggcctttaggggtaattacaggatgctgctatgtcaactaggatgctgcaggttgaatgctgaacacttctcataggatgaaatataacccagccagggtttatctgtgtccaaagtcacgagttgcctttcagtgtgaccctccatttttgttaaatgaagcacatttggggtcacagaatattaggaatgaaaaggataaaatcctgaatgaaaaatattaaaatgtg

SEQ ID NO: 391680 - DNA, 215 bp, Homo sapiens
ctttgccacatatgccgcttgtctctccaagtataccgtaagacccttgaaggcagagatcccatcaattacctcttttagtcccaaaatgatggcacatgtaattagctctcaaatatttgttaaattatttcatttaaaagattgagggggtggccagacgtggtggctcacgcctataatcccagcactctgggaagccgatgggggtgggg

SEQ ID NO: 391681 - DNA, 438 bp, Homo sapiens
aaaaaaaagaaggatgctattctgtgatttgaagcttgagatgtttaaggaaaggaaatctaataagtggacacctttaaaaaatgaaatgtaggccaggtgcagtggctgatgcctgtaatccgagcattttggaaaactgagccaggcagattgcttgagcccaggagttcaagaccaacctggacaatatggggaaaccccattgtattagtctattctcacgctgctaataaagacatacccaagactgggtaatttataaagaagagaggtttaattgactcagagttccacgtagctagggaggcctcacaatcatggcagaaggtgaatgaggagcagagttacatcttacatggcagcaggcaagagagcttgtgcaggggaattcccatttataaaaccatcagatctcctgagacttattcactacca

SEQ ID NO: 391682 - DNA, 601 bp, Homo sapiens
tgtaggatttagttaggtggaggacgaaggtagcacatcgcaggggccaggactgagcatcctggttagataattaagtctttctgtggttcgttgaggcacagaggaaaccagcattcctgcagtcgggtgaatggtcagcaggggaaggggagagtggtaagtgtgcagggaatagagggtgagaccagactgcaggagaactcaaagacaaccatgattgctgggtgtcagctgccatcaatcaagttgttgctattctcatctacctataagtaaaccaccagaataaaaggtagttacccaaattcccttcttgaggagggctgcttgatctgtgggctgggtagaaattccgaaccagagatcaaagagctgcctgcagctgttgcagtcctagcacctttggattctttgatcctcaatgtgctgaaccacctgctctgaaataactgctcccaccagggaccctgtgcctccctcacctactaatcaaaccaggccaaatgtaagcacaatccacctatggctcactttccccctcaggttaccttaactgcagatcttggctcacactgcttgagtacttactccgtacaca

SEQ ID NO: 391683 - DNA, 588 bp, Homo sapiens
ttcttccttaatatgtaataatgtaatatgttaaagagaatggaaaggttaattttactgtgagttatgggccaactatgtaccaaacataatactatattagtgccttgacctgtggggcaaagcacaggatctatcacagtgtctggcacataacacagtacgtattcataggtcaatgaatgagcatcccactagattccaagcttcatgagaacaagaagtctgatctgtctacagtctactgcagtcacttaagagcctggcactgtgcccagcatgtagtaaccagtaaatatgttaaggatttatgctttgaaacctaaaattataatatattttgtttctcaagttgagcatatacattacaggatactcttggagcaaaacattgatgacatattttgccatgttagagtagttccaagccatccagcctttacctaaatactcaggaatacttaaataactggcaatgctgcagaaccattatagctgtattttagtatcaaagtataataagcaagtaaagtagacagtgtctattcttaaaatagaaatccataggtgcctttaactgaaaattaa

SEQ ID NO: 391684 - DNA, 846 bp, Homo sapiens
ctgagcctctactttccctccaaaataactgcctccgctgtgacctttgatcaccagggaaatgtgattgttgcagatacatctggtccagctatcctttgcttaggaaaacctgaggagtttccagtaccgaagcccatggtcactcatggtctttcgcatcctgtggctcttaccttcaccaaggagaattctcttcttgtgctggacacagcatctcattctataaaagtctataaagttgactgggggtgatgggctggggtgggtccctggaatcagaagcactagtgctgccattaatgaattgtttaaccctggataagtcacttaaactcatctatccaggcagggataattaaaaccatctggcagacttacaaagcttgggacagttattggagattaatctaccatttattgaatgcatactctgtgcaaggaaatttgcaaatattagcttatttaatctgtactatccagtgaggtaatttcttcccccccaagatagagtcaagctctgtcacccaggctggagtgcagaagcatgatcacagctcactacagtttcaacgtcccccgctcaggtggtccttccacctcagcctcccaagtagctgggaccacaagtgtgcattaccacactcagctaatttttgtattttggcagagatggggtttcaccatgttgcccaggctggtctcaaactcctgagttcaagcaatccaccttcctcggcctcccaaagtactaggagtacaggcatagccacttgctcagccataatttttattattaatctcattgtacaagtgagaaaactgagacccagagagcttaagtga

SEQ ID NO: 391685 - DNA, 378 bp, Homo sapiens
tcttccattttctagacagggtaccagaggccctgaaaaatcaaaggacgtgcccaacgtctcatgactagggttactgtggcagagtataaactggaactcaggtctcttgatatgagacctagtgcttattcctttacattcattctttttaacaacaaggtatttatagttccaaacactataaacaatgacagaggaaaaaagaaacagaaagaaaggaagaaagcgggaaaggaggaagggagaaaaaagaaattttagcaacattttaatataaaagaatgttgaaaaacgggggtagagggtgtgagcagaaaagaaaaagtattagaaaaaaagctcaaccttttgtttcggagattaatttttaaacaa

SEQ ID NO: 391686 - DNA, 371 bp, Homo sapiens
agaggaccccagctcagggcatctggtattcgtgatagacgaatattcaggagacacaagtgcttcttcagaccaaacatctcacaggcagctgaactacacaggctcactaagggtgattacttagcaaaacctgtacttaaaaaaagaaaaaaatcaaaacagttatcaatgaattctttccacatggtttcttagagctggggaaaagaaaatcttcacaaaacactgtccaccttataatgattttgagaacaataagaaaaattggacctaaaacaatacccctcctgctttgagggggcctcttgtcttctgcatggattgctatagttgatggaaactgacaggtgtattgtttctgagagcta

SEQ ID NO: 391687 - DNA, 884 bp, Homo sapiens
ggttttttctcccacctgctagtattatgaatatcattttatttaccaaacttctctttttcagaatttattctcctccatttagatttgggaagtagttagttcagcacagttttgatcacctgccaaggcctaagcattctactaaatggtacatgtggaggatgtcacagtttggcctgaagaactttaagcctatttgatgaggaacccattcccaggaggcagttagagaatagtataaaaggacatcatcacaaggcagcaggtcatgaggacagccagcactctataagtgttgggaggaagacagtggtatgcccttacataattagaaagggcttcttcaggaaggcagggcaggaatgattccattgccagttgggtgttagtgtttcagccgtgtctgtgctttctgaaacttttatgatcctattattattgtctttgatagtttgtctgtgtttaccagaatgctggtttcaataatgttagacttcagagttgtttccttaatattaacagcctcatattctaccccttgaagtggtcattagggctagtgatacctgccctattaaagtgaagtgaggctaagagacttgctttgactcataaaatgtgagtagctcacttccaggaggaagcattcaaagtaccagtgccagctttggtgcagatcttattttctctggccccctagactagcagggttcaagataatggccattttgtcaccctgtgtcccagaatgattatgatgagtgattaccctgatcatccctgccaatccaggatgaacacatagtatgagaaggatataaacctttgtggaagtcctagtaagagaaattaagcaagagaaagaaataaaaggcatccaa

SEQ ID NO: 391688 - DNA, 714 bp, Homo sapiens
tccaaaatggttcgagttcacagaaattccttctatccctaaactcctgtttgttaccaccacctaggcaaacgttttttctcccctaattgtttgcatgggtgtccaaccttttggcttccctgggccacattggaagaagaattgtcttgggccatacataaaatacactaacactaacgatagctgaagcgctgaaagaaaggtttgtgcataattttcctgatatctgccactacagataagcaaaaaaatccgtgcgttccacggtttggacacgggtggtttagggctatatttttggttccttaagaacagggaacaagcctgacactgtcattccactctttcatttttcccatgggccctcttacctaaagactgaagtgggaacactttagcagagcatatgggcattgtcttgatcacattcctgccttcccagccagcctgtctcctgccatcctcctcctgcttcccacgcttcagccagagcaactctgtctggttccccaggcatttcctgttcactcataccctttacttactgtttcttctcgtgggattcctgcttttagtctctttctctacctggccaactcacagtccttgagactcagtcctgctcatctccatctttagaggcttttccagatccctccaggctgtgcacaccttgaccagaactcataccttactccacgctgcatatta

SEQ ID NO: 391689 - DNA, 1539 bp, Homo sapiens
tctcctgcactcagtacaatgcttggctcaaaggtgtggtagttctccttgattgtcattgctgctttcagacctttttcctccatagaccactccaacttttaatctcatgacatcagagtatcccttgtttaatcacttttgtggttaaaagagacctttgggtcagtctgcctcattccttgaagagtttagccctggctcacttttcactctatttcttctcctgtctcaagaaagaagaaaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttaaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatgtatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgag

SEQ ID NO: 391690 - DNA, 251 bp, Homo sapiens
acagctctccctgaaagaggcagtataggtctccttggtgcagacaaaggtactgatggcacagaagtgaagaaacttccagtgaaacacaagccccaatctatgtgactgggctccttgctcttccctgggccttcctccacctcccagctcctggcagggacgctggaccacacatcatttggtagaatgtccccgtgactgggcatgagccagcagtttactaagcctaaatccatatatcttcattt

SEQ ID NO: 391691 - DNA, 571 bp, Homo sapiens
taattaattataaaacaaagatgaaaaacagtatattactcaaagcaggattagaacttcctcagaggaagtccaaaactgaaggagccctcagaagtatttaacctggggctgggtcaagaagggcttcctggagaagggaatagctaactgaagatttgcaggttcactcagatattatcaggtgaaaggagccaggctgaggacgcggcatattagaaggcatggaaataagagagaatagggctattatgttagaggaaaaatgagtttggtgtagctaaaatataaaatgcaagtaagtccaataggcctgataggtagcagtcactctggctgagggtagaggaagaattgaaggaaagaagaccagaagggagactagagggaggtcacccaaaatattctttcagtaactgcaccagaccaaaagcagagagaccaccagatgaaggaggtaattttgaagcacaatccgaacagccatggattcagaaagtggtctcaaaggaaaattccaggattcagggaggtgggaggagagcttaactggaaaattgaggtggcattc

SEQ ID NO: 391692 - DNA, 695 bp, Homo sapiens
cagcatactttgtggtatgttatcagctgaaaccagaagtctttttgaaaaatgtcattgttgcatggggctttaatactgaaatcctaggaggtggcctttcttaggtcataattttttaaattgctgtaatgcatgtttaaagaacgacagtacacacgagaagacaaaaagtggcctgaagctttgggtggaagtcaggtagatttgattcagcaagtaatagaagtcaacatttaatgaacacttgctttgtgccaagcacactgttgtaagcactttaaatatattaagttatttaggtctcacaactttgtatgatagtttattatttccatttcacagataaatgagcttgggcacagagaggtaaactgatgtcctcaaggtcaacagctactaggtggaggagttgaaatttgaatccgggccatacaccattgttaatcgagcatttgtgttaactaccaagtacttactgggccctggggatggctctggagcagtggataagtcagatagctccgatccttgcttgccaagccataccatcattctcagcttcagtttccccaaccgtaaaaccagcacccaaaccctgccctgcgcacctgctaagatttgtttgttaggatcagttgcattaatgcaggaaaatgtgatgttcgtgcatggcagaaggctgggttgatcaa

SEQ ID NO: 391693 - DNA, 490 bp, Homo sapiens
tccctgttgcccccacccccaccaaggtcttagattggcagcagagggcacttgtctcccactgatggtagatacacctgcatctttgttccagttggccaggcagtgggatagtgtggctgaagcctagtattctcactttcctaggcactcagtttctgagaagacatacttcctgaaagtccacacagcttacttacccccaggcagctgttagtagcagtttgttttcagcccaatttcggcctcagtcccttatcttaggtgggccacttttattcctgtttctataggatctgaaacctaggccttcactggttccttctgaaaccagagcctagcagccctataccttctgcccactctctgttacatatttctgtttcatggtgatgctggtcttttttagttaggtaggtctttaaaatgtcttctccaggattttgcctgttgttgctttgtatttgaaacagggtgggttttcaaagca

SEQ ID NO: 391694 - DNA, 535 bp, Homo sapiens
tgacagccacagggtctgcctgagaagcgaccaagagcagagacagacagggaaagtgaagcctattcctggctgcgctttccaagttccagtaaagaggttatgtgactttattcatggacttggtattttaaaatattaacgaagttccacaaacacatgtacctcccagccctcaatgatgttaaaccccagagttccccctagtttaacagctagtaaatcaagttttaaatttaaggaaaatgaagtagcagaaatttaatactgttgatcttataattatgttttattttctatctttaaaaggcattattttgaactttcaccttctgatttaaattgtttcaaaggatacaacgaaactgtagctgtttatcagatagaagaaatggtttaaggtgagaggggaagtaaaatttatcagggatttaagtaaatcaagggaatggataatgagtgtttttccccttatatcgttaaccgggagttactcccagaataataagcaatgttgaatgtacactctaaccta

SEQ ID NO: 391695 - DNA, 293 bp, Homo sapiens
gtgtgcacgtgtgtgtatctgtgggtgtatgcacattcgattgtgtgggtgtgtgctatctgtgggggtagttgtgcacattcgattgggtgtacacgtgtcaacgtgcatgtgtcagtgtgcacatgtacacgtgtgtatgcacttctgcatcgtgcatgtgtgtgagcgtgcatgtgtgcacatgggtttaaagcagtggtcaagtaccggcatgcgcgaagcacccctggggctactcaatggccatcaatggggtcctcaggcttcagagtgctttaggagcgtagact

SEQ ID NO: 391696 - DNA, 829 bp, Homo sapiens
caagctttaataaatacctcattttatgtaaaatatttattttacttaataacttgctgtttcatttttttattaaaaaagctttagaataatgttgtattgaatatctgaagagattattatttcagaaaagctgctaaaatgacatggagagttcctatatgtaggcatgcctcatctgatggcactgtgctttactgtgcttcacagatactgtgtttcttacacattgaaggtttgagttgagcatatctacccgtgccattttaacagcagcttgtatttacttcatgtctctgtcctattttggtaattctcataatatctcaaattttttcattattattatattattatggcggtgtgcaatcagtaatccttggtgatactattgtaattgttttggagcaccatgagccacacccacataggataacaaacttatttggtaaatattgtattccctgagacaaaacaatattgaaattaggctagttagtaaccctacagtgacctctaagtgttcaagtaaaaggaagagtcacatctctcactttaaatcaaaagctagaaatgatttaaggttagtaagaaaagatgttgaaagccaagacaggctaaaagctaggcctcttgtaccaaacagttagccaagttgtaaatgcaaaagaaaagttcttgaaggaagctaagagtgctactccagtgaacgcacaaatgataagaaagtgaaatagctttattgctgatctgaagacagcttgaatggtctgaataagatcaaaccaaccacacaacattcccttaagccaaagcctaatccagagta

SEQ ID NO: 391697 - DNA, 764 bp, Homo sapiens
ccatgttttttactttagctttaaaaactttttttattttatttttcagtagctacaaggttgtctttaaatattctttatagtaactaacaccctgtaggcatgaccagtaatagaaataatttcctcttttccttggctccactgatgcccactgcctcttctttgtgatcagttaaatgtacactttagatgattctaagctttgtaactgtactctccttaagttttaaatcccattactgaaaagcgtatacagtttggctatcaacaacatgtgtttgtcctgtggaaatttttttcaataaatatattggtaaattttttggagattttctgcagtttgaaaaaacttgaactatgtaccctagaaatatttaaaaacattaaaaaggtatgtcatgaatgcttaaaatatttgtagatgctagcctgttttatcatttaccaacatgaaatgtacacaaaatgtgtgtgtacagactgtacacggcactatttgcagtcaagagaagtgcaaacataaaggtgcagtgttaaatcataactgcatggaattaactgtagtatatgccatactgctgtaataactttgtagctacctcctgttgcttttgcagtgagctcaagtgttggaagtatccctgtgatgccctgtaactggccaggtgtggtcactcatgccagtaatcccagctctttgggaggctgaggtgggtggattgcttgagccaaggagttggagaccagcctgggcaacacgg

SEQ ID NO: 391698 - DNA, 211 bp, Homo sapiens
gaccccatgtctgctggtcctcgcaggtgctcagtaaatgaggaccctggagagcgcggccttcatgttcccacgtgggatttgaacacagtttctgaggcgagcgtagtggtgggtggtactgggcatagacttggggcctgatggtctgtgtgtgaactgtttctgtactcctccagcctttcccttctccccttccccacggagagac

SEQ ID NO: 391699 - DNA, 794 bp, Homo sapiens
caggaatatttttgggaaatgccatgactcctttcttgttctcattaatggtgaattgggaaacatgagttttgggggaagagaaggaatccctttatgaagtaatgcaaatttaagataagttttagggagtactaaggtacttttcacctctctctaggatctcatacatttagtgatacatatacatgcaagaatccaaatgagtttctcaaatgtcactgaaaatgcccagtgtgtttgcattgtgtagctgagactgagcagttgtgaccttccccaggaaggtccatggaagtgatgaatgtgaagggtgcattgcgcggggctgcacagccagctgttttgctgttactgtcttcacagtctctcttgtagtgcagctagttccagttttcttctatgtagttgttttaatgattcttttacataagccaaacagtcctttttacaggtccacatagttcccttactttcctgtcttcgtgcctttcttagtccctcagctttgagttcttctccttttgtgtatgtcaatattaatctattttgaggctgggcacggtggcttattcctgtaatccttgcactttgggaggccgaggcaggtggattgtttgagctcaggagctcgagactagccttggcaatatggtgaaaccccgtccctactaaaaatacgaacattagctcggtgcagtggtgcgcgcctgtagtcccagctactcaggaggctgaggcaggaggatcacttgagcttgagaggcagaggttgccgtgagcttagattatgc

SEQ ID NO: 391700 - DNA, 911 bp, Homo sapiens
catttaatactttccatggccctatgaactaggtactgttattttcttctttttacaaactgaggtaaatttagtgttgtcatgtgcagtttgcacccttaactcccaacactcacttctgctgggtacatgacatattgaatgaatactatgtttgtaagagagagagaatatgcatgaatgaatgagagagagcatacccaaacagggaagcaaactgatggatttggctgtagtcaaattgttgttgccaaggctgtactttcgtggcaactacaacactgaatcacgagaatttgcctcaaatctcccttctcttacagaacacttagaataaaaaacaacagctgcttatactgactttcttctttaacgacactcgcacatacctctgacttacttcactcccgcataagacacatactagagctatactctcgacaacttcccggacagctactctcccctttcctcatttgccaaaaccactccacagctccattcctctagttcacctttatttcacctttaacattggtataccagtcacctttccacctggcgcccattcattacatgctgaagaatactccctaacaacatccaactgcaacctcccgtaaccaatcttcctggtccataaatcaccaacaacccccattttcattacaaaaaaccctggctacttttccacttatttcctccactcggctctacattaggtccaagggctaaccattgctcctggccacttactccactggtaaacctacaaacagccctaacactctcccctcactacccctaccctcgcccctggggcccacaccagggctaagcctcctctcacacggccccgcccagatcaatcctcccagcgcataataccactcggcactcctcgcacaagc

SEQ ID NO: 391701 - DNA, 380 bp, Homo sapiens
ctaagacttagggctgtctaatcttttggcttccctgggccacattcaaagaagaattgttttgggccacacataaaatacattaaccctaacaatagctgatgaacttttaaaaaattgcaaaaaaaaatatcatgttttaagactgtttatgaatttgttttgggctgtattcaaaaccgtcctgggccacatgcagcccatgggccacgggttggaaaagcttggtctacgtactccttgtaatttagtaaattataaaagcagcatttcagacaggcgcggtggctcacgcctgtaatcccagcactctgggaggctaaggtgggcagataacgaggtcaagagatcaagaccatcctggccaacaaggtgaaacc

SEQ ID NO: 391702 - DNA, 549 bp, Homo sapiens
aagggacacattccccttggaaaataagatcgtgtttctagtcttttgggctgaagaattattccaagcatacgcttttttcatctttctgaaatgccaggtgttctgagaagtaggtatttacatctcgtggaaagacaagaatttgtctctccagctggattagcggaactgaccagccagttattttggcaaatcagcatccacatcaaggtgactcttctctgagagaaactgatgaagtgttcaaatcagctagaaaggtctgatgttccatgatcactataatatatagatcccatagcagaaaaagaagctatatagttgagtgaaatattcgaatactttgcagagacagatgagttatgcttttttaggctttaaaaacctgttttcttaggaagctgccttggaaagacacagctagatgttaccttcctatcagccgagtgaatgtccaaaactcactggagggaagaggcagggctgggtagaacagagtttgacagaaaataacggatgggtcactggaatatgtgcatttaaaac

SEQ ID NO: 391703 - DNA, 308 bp, Homo sapiens
agaaaacatgagacccctggatcagagacaaagactttattactcatggcacagcaagcagcgtaggcatcagtgttcatcagttcctatttctctcagctcccatggggacagcatgtgggtctacatggatgctattcatgcagtgcatgggcatagccactgaggaacactgagcctggataatccattgcttttatagtcagcagtaagcaaccctactgttcgtgctcttatctcaactctcaaggttatcagctgcataaataaccctgggaaatgagtagttagaatcttgcattctaggc

SEQ ID NO: 391704 - DNA, 137 bp, Homo sapiens
tgtgggactcaagagatggcccgaagggataagggggaagataatttaacctgagaaatgggatgagtaccgtgcagggttcttgagctcagtctaggagtaggaagcagtctccatgtaggtgggacacagcacat

SEQ ID NO: 391705 - DNA, 285 bp, Homo sapiens
gagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaag

SEQ ID NO: 391706 - DNA, 389 bp, Homo sapiens
gggagaaaaaatactaatggaaaatctgagaaaatatcagcatcactaagataaaccaaaacctattttaacagaaaaaaatggtgcaatgtttcaagaagaactggaattatatattctgaatgatcctaagctgataagccactactgacttaggggataaacattttattacagcagtcaatttggaagttataaaattcctcctttgggagttatttggggggttagaatagggatgcagctagaaaaatcagtgaaatctccagaatgaacagcctggcactttagtatctcactgggcactcaggaaagctatactatagaaagcaggttaccatttatgatagttgtattttctgtgttatctagagaaaaacaggttcatc

SEQ ID NO: 391707 - DNA, 595 bp, Homo sapiens
attgaagactgtttgtggagacatggtttttgcatacttgaactcctgacctcaaatgatttgcctgcctcggtctcccaaagtggtgggattacaggcgtgagccaccacgcctagcctaattctttataattccaaaagatatttaactgaaacctttataattaaagacatcttaattgtacttaattaaatatgccaccaccttatcaccccaaaaaaaaaaaaaaaaaaaaaaaaaaaactgtgtgtgtgggggcgcccggggcccccggagagaaggcttttcagagaccccttgcggggggggcgcgcgggggccccggggaggtctaaggtggaacaggggccctaagagcggtgttccctcaagggaaacaccgcgggcccggagaacaaggggcgcggggtttccccccacctattaaaaaagcgccccgggggggcacacgcggggcgctttttgtggaacaatttccccgagtgggggtttcgcggagggtcccttacgcggggtattcttatccacgcggggggttcccaaaggggaatctccgcgtatttccaatttaacccccctcccgcgctgggtgga

SEQ ID NO: 391708 - DNA, 531 bp, Homo sapiens
tgagtaatgtagtgagcaccaacacctctgacaacatcatattatagtaggcaaaataatgcttctcatctctcttataatgtctttcactaggtagacataaaatacaatattgacagtataatctggaaaaagtcattctagaagagaccaaattaattcagtcttagtactgtattcacccatttgatggtttatctttaattgaataatatttggacttcctaaataaatgttgtgtgtttttcaggaaattctgtatgcatatttttattcaaaactggatttgggaaagattaggcagtggagactttgttgtgttcatttaaagtcaaataagatcaaagtgtatatacatatatatgcacacatggatcatcaactgagcctagagtaacattaaatcatcttggccatgcccagtggctcatgcctgtaatcccagcagtttgggaggcccagacaagtggaacacctgaggtcaggagttagagaccggcatgaccaacatggtgaaacctcatctctaat

SEQ ID NO: 391709 - DNA, 251 bp, Homo sapiens
tccgatacatacttggtgtgggagtggtttggcctgcctaggctagcacagggctctttggaactgatttcagactctgggcctggttcccagtaggagagaagggctgctgcctggaggaacctcatctaggtcccaaggtgaccccaggagagagacctgtgggtgggctcaggttcatttccactttactaatcaccacgaatctctgcccaaatccaacttccacttcttttccaataggacactta

SEQ ID NO: 391710 - DNA, 207 bp, Homo sapiens
ccccagacttgcgatcagaagaacctgatgtcaaatcagatgcatcttatagcaagtcgagccacctctctgaaacttgaatttaaatgatctaaggtcatttcctttggattttatagaaagaatagtgtcaggagaaaaagaaaaacaaggaaccatgacttgctaaacatactcagaaccaaaggttttctttctttcctttta

SEQ ID NO: 391711 - DNA, 804 bp, Homo sapiens
cactgcactccagcctgggaaacagagagacattttgtctcaataatattaataataacaataatattttgactaggtcttaaaaataatcatttcagaaattgacaactatttttaatgccaaatgtaaaaggtacatggaaataatgtcaaaattctttcccggtcttatttacaaaagcatgtaaggaatattttaggggggaagtttccaaagtgggagtgtgcacacattcacattgaaaggtttgtattaccaggcacataagaatgtggtgtagaaatagtgggcgagaataagacagaatgcttttggtattcacaactcaatcttggagggtgacactgtccctgcagtagctccaattaatccttcccttttcccacagcccctttctacatctgaccttattcctaattgctgtgactttccaattagaatggaactagttgagactcttgatttaaaagggaccattagatcatagtttctattcaaggaagtctagctagacaccacctttcattagaggaaaccctagtacaagtatcctaagaaacaacaaaaatctggaaaaaacaggaaagccagtcaagacacatatttccctttagagaatttgcattggttaatgcctttgcactgtggagatatgccctatgcagcctatagtctgtttctgtgtggactctgcagttgtgggacaattaaaataatagtcacaactgaggaatacaagagaagagttgcttgtctttttacagtcatggcattctgtaaagtgagaagtttggactagaata

SEQ ID NO: 391712 - DNA, 269 bp, Homo sapiens
cagatgcgtgccaccatgcccagctaatttttgtatttttagtagaaacggggtttcaccatgttggccagaatggtctcaatctcttgaccttgtgatctgcccacctcagccttccaaagtgctgggattacaggcgtgagctactgcgcccagctgattttccagtctttgtacaggacctggttttgtttttttgttttttccctctttgggagcttttgtgattagttcatccctggtattctgaaatttgatgatgatgtcat

SEQ ID NO: 391713 - DNA, 280 bp, Homo sapiens
tttttttgcttgttttatggggctagttaggtagcgcttagctgtaataatattctatgtgaatattggctgattaatgtgggccctaaatattactagatagaggggtgtccctagagcctaccaggaaagcatcttggtcttttagtgcatcaaatgaggaaaataaatgcaattgattaactctgcaatgaagagtagaaagataggaagactagtcaaaacaaaaaacaaataagaaaacaaaataaaactccaaactaacaaaacaaaaccccac

SEQ ID NO: 391714 - DNA, 773 bp, Homo sapiens
tctcggctcactgcaagctccgcctcccgggttcacgccattctcctgcctcagcctcccattaatttttaaaatgtactaattttattatactttatagtactttgttatgctttattagattgtataggacttggatttagttactaaatagaactgaaaagaatatttatataagaaaaaagttatattaccagcgatagcctgctttatattctgaaagttgcagcagtgtctttattgtatatccttttaaggcagcttcatcactgagaacttttttgggagtctggaagcgtactttatttggtttaggatttaaacatctaataaaaccaataaaagatctcccagatagctaataaaatatatttttcttttggttcattttcctcagccacagctctcttccattgtcaaaaaagaatgtataccctgtatttttaaacagaagtgactttagtagatttatggtattcaaaagatctgtcactttagtctaagtgtagaatatctggaccttagtttctccataatgtgaatcaaggacagtattgatcatgcagagattagagatttaaaagttttaaatatttcattttaaagtccaaattgatagtgtaattctcaatttctgccaaatataagtagaaaaaaagctttcaacagaaacctgtttttcagtcgtaaagctgaattctcctagtggcacatcagctaaatgtggtctgagtgatatctagtctgattcttaaaaaaaagtccagaaagaa

SEQ ID NO: 391715 - DNA, 746 bp, Homo sapiens
tggacacagtgtttgaagagactgataaagaaagtacaggaggagttttatttttggaagaagaaatggtccttgggcacagaccccatatgagttttcctttcagcgttctctgctcagctgttctctgctgtggtgaggcgcctatgctttgtatatgtctgaaattaattgaaaagctagtgacagattctgatgtcatttgccatgagctttattattgtgcaggtaattttggatcaaatcaccctaacgtttttcaacaaagactttagaagaaataaagctgcattactttttcttggcgcattcttcctttaggacctatagtgaggtaagtgacacaaatatctctcattctctgtttccaaacagtaaatagaatatacacatagttcacgaacaagattaaggaagtgataactcatcgttcctctaactgaaatgcaccctctgtttagatttatttacttttcacaattttgaaaattttcccatgcaatttttatcagtcataaggtaatgatagttttttaacaatgcaaatgggattaagtcagtcgttttttctgttccttttaatattattctaattcagcctcatgggcattccaaatagttatgagggatagaaatataacattaaattaagggatgagagtagagtgagaagagagtatggctcaaaattaatctcataaattttatttgtcaactgacgtgatttaacacgttagtggtagatt

SEQ ID NO: 391716 - DNA, 234 bp, Homo sapiens
ggatagttcatcgagacttactttatggtccagaatctggtctctgtctttgtgagtgttccatgcacacttgatagaacgtgtgttctgattttattgagtgttctgtaagtagtcagatcatgagagtatgtcctctgaccacatggaactaaattagaaaccaataacagaaagtaagccaggtgcagtggcacatgcagggagccccagctcctcaggaggctgagctgg

SEQ ID NO: 391717 - DNA, 437 bp, Homo sapiens
aaaagaagttattttctgtgatgtagcatgatttctccccgataatgcaggctctgggctggcagtgcctggcttgcttctcctctacaccaattgatattctgctcacagcgttgcacacaggagagtcaaggccaaacccagaggatgcacaatagtaacaggccaagagcaggctgttttctgggagacagatcctgttaccctcttgttgtttggggatagcaagaagtagaaagaggagcaggccttcagcagtgtctgaaagacaaacacccgtgctaaatcactacaggatctacctgcaggaacttcaaggaatcaaaacataactctgagctgcatggtttccggtaaacaaaacactccctgttctttacccaactgtattcctctgttcagcagccatacaattgccatttcgtaagccgggagcc

SEQ ID NO: 391718 - DNA, 289 bp, Homo sapiens
ccatgtcaagtacacacccacatccctcttatcccaaataccaaacacacaaaaatccaatctgtctccttctacctaagcaattttagatagtcactttctcataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacacaaaaaaattggccctaaatgtt

SEQ ID NO: 391719 - DNA, 528 bp, Homo sapiens
ggcatgacttctgaacagggacctgaggaagtaagagagcattcacagaacagctagggaaaagagtattctaaaaagaaagaatagcaagtgtaaatgaagtacccaaggaatgatcttctatgagaaggatctgggttggaaccagcccttcttcaggtcaaaagtctataatgagtccctatgctctatggcaacaaatctaaattattcaacccaactttccatgttttcccaaaataatcagcctcactatcctatctccctagcacagttcctctgaagtaactagatcaggctcactaatattccctgtgctaagctcattccatctccagatggctattaggttcaacccaatgcctatcatgaagcatgacacgttaacatagagttgggctctgatataagggacagagactgggtcatcaaaaaacaatgccataggaggaatctgtctcaataattgacatgggatccagttcctctctcactgagtctgtctatccccctaccctgtggaaaata

SEQ ID NO: 391720 - DNA, 295 bp, Homo sapiens
aattgtcgagagagggaatggggatactgctttaattcatgtatgggagcatatagacttcgctcttatcaaatgttttcctatttctattaatttgggctgtattcctctggatattgtgatgccgcttcctctgtcactgcctcctttccttttcgttgcactttaaacattggcttccacctgcaatctacccttttcttgaccttctcctcactcctcagttttgcatgggcaacttcctttcaggttctttgcagctagccacttgtatgcccataaatcccagcttaaa

SEQ ID NO: 391721 - DNA, 132 bp, Homo sapiens
gatgcttcagactcagaagaggcacagcccacagtcccttagctgaaactgttggaaccagatgtgtttcagaattcagagattttccagatgtgagaacagtaaacatcccacatgctgagtaacagctgt

SEQ ID NO: 391722 - DNA, 245 bp, Homo sapiens
cacttccctgggaatagattctagttcctttactcatctgacctccacctgacacccctttcctgtctgttcatgtgttcattcattcattcattcattcattcattccacaaaccagtattgagcacatttgagggccctacgccgtaccctttgccaaaactttctcttggaaaattccattctttgacgccaggcctggcctttccaggtgtctgacatccccagggatccagtagcttcca

SEQ ID NO: 391723 - DNA, 381 bp, Homo sapiens
ctccggggctcttaactaccacatggcattgcctccatcaataggagaagtaggaatactttgttagaagaaagagctggctacataggcaattcacagaggaagaaacacaaacgcctaatatgtgaaactttggtcctcactagtagttagaagtgcaaaataaaccgagatgggatggctggaaaagcctcctgcatggatgactgttccttctgcttggtgggtggattcgtttcttgttggactgtgcctgcacatttcgtgactttctaatgaagtggatcgcctcaccttggcattgagtctcttgagggataaagggcagcgattgactgggagaaatccagagtctggataatcagactccattatccatta

SEQ ID NO: 391724 - DNA, 652 bp, Homo sapiens
taatctaataagaaatggaatgaaatgatcatcctgttttattgtctttaacattaatgttttctttgttagtattggatgggaagtcagtcagatggaatagaagaaagaactgttaaaaaaataaaatgagcttatttcacttgatcaatcaatttcagatataaaataattaagctttacaaatagttaaggactctttgaacaaccagcttaaaatctctgtgcctcactcctgtaaaataggcataaggagagttcttacttccatgcactattatgagaagttaaaaaggtgatacttattacatactcagaacaacgcttggcgcataataagaattcaacaaattttagttattatttcctttctcagtctctccctagagacaggcactattaaaaatctagtgtgcgtatcttccattatttatagttttacatgcatgtatatgttgttagaagcattattattctttcgtatatgtttttaaaagattgtgtaaatagtttcacactatattttgtaattttttttcctttttttttaactttatgtttggactctaaccaagtaaatagataggtagaaaaaagaaaaagagagatgataggttttaatatatatacatactaattatatatatataac

SEQ ID NO: 391725 - DNA, 412 bp, Homo sapiens
attggctcctggactgctttgctcaggacctctggatgccaggggtcgtatcaggggctctaaggtaattccacatgcccagcagattcagcttagagaaacggtgctcacagtgctggggtaggagcagagaaggctaaatgaaggactccggagagctgcaggtggatctggaccaaatccagaacccaacgccttactccctcctggggagagagctgggcagagacttggggcgggcagtgaggtggggataggtgagcagcactcgtggtgagtggccccagtgtgatttaggaggggtgcagtgtgggatcccagggacatgaccagtcagccccgccctggctttgacatgggggtgcctggcagtggtggctagagaagtccagtttgccaagagaatggcaca

SEQ ID NO: 391726 - DNA, 228 bp, Homo sapiens
ggagttcgacatcagcctggacaacatagtgagaccccacctccacaaaaaacttaaaaagttagccaagcatactggcatgtgcctgcagtcctggcttcttccttcctttccttccttcccttccttccttccttctctctttctctctttctttctcgctctctctctttcttttctctccctctctctctaacgctggtgcatgctcaagattcagctatggcc

SEQ ID NO: 391727 - DNA, 198 bp, Homo sapiens
tggcacgtgcaaaggccctaggcagatggagcctggcacctggaagcaacgggctggaggggcagagagcagtgctgacagtgtgggagtgtggaggtggtgctggcaggggctgcagcggtggtggcagctagcgtaggacagtcacgagatttaggagataaaatagaaggtggcggcagagagggtgcggagcag

SEQ ID NO: 391728 - DNA, 536 bp, Homo sapiens
cggagtctcgctctgtcacccaggctggagtacaatggcaggatctcggctcgctgcaatctccgcctcccaggttcaagtgattctcctgcctcagcctcctgagtagctgggattacaggcacccgccactacgtccagctaatttttgtatttttagtagagacggggtttcaccatgttagtcaggctggtctcgaactcctcacctaaggtgatccgccctcctcggcctcccaaagtgctgggattgcaggcgtgagccaccgtgcccagtcccaggcctctagaacttcggaccaatgggcctcaagctggggttcccaagacccctttttcaggtttggttaatctggtggagccagttatagagctcaagaaaacacatttgtcagtttaatatcaaggatattgcaagggatacagatgaagagattggtagggtgaggcatgtgtaaaggggcacagagttcccatgccctccctgtccacatcaccctccaggaggctccacatgttcagctgtccagaaactc

SEQ ID NO: 391729 - DNA, 348 bp, Homo sapiens
aaatcgagctcggttccccttttggggtctttgctacttgggaggctgaggtgggaggatcacctgagcctgggaggccaaggctgcaatgagctgtgatcgcgccactacattccagcctatgtgatagagtgagaccctgtcaaaaaataaataaataaaatttaaaaataaataaagaaaaacgaaagctctatacttatttgttggagaacctaaaacacatacatcaacaaggacatcttcctccagtggatcatcatcatctggaaaatactgacttcggatatcttactacagggagagtgtgagagagaaatgcaaagagataatgctagacccagataa

SEQ ID NO: 391730 - DNA, 141 bp, Homo sapiens
gcaaaggtgtgcgccttggcatctggggctgcgagagcctgtgtgcctgggtatgcagtgggggaacgtgagggacacgagtgtgcccagtttcctgtgagaaggctgtgtgcatacaatcccgcatgacttggctgtgtg

SEQ ID NO: 391731 - DNA, 286 bp, Homo sapiens
ccttctgccctgtgacttcccacttcttttaaggataccactcatgatactcaccataatccactataacatcattgtgacttaactaattatttagaaataggttctttgcagatgtaaagtcacattctggggttccagtaaacattaaattgggagacactcttcaacacagtacggttgctgacttcaatgctggctgaccatttttctgtttccctagtcaaccattccattctctgcagtagcaatttcaagcctcctctgcccatcctcaacatcttgt

SEQ ID NO: 391732 - DNA, 778 bp, Homo sapiens
agggtccgcgtctacacgcggctgtgaggaaggaaggcgcgtgccgcgtgggacgggctccacctgcctgcggacagatggagggtcactttgttccgagaagacccagacacccgagggaggatgtgaaacggaacgacccgtttcggtgcggttggctttgtttatttgcctactccccagacgcctccagcctctgattccggcacaccctgtgaggaagcaaacggctgcctcccccactgccaccagacgaggtcgcctgccccgagccggacaggctggacaggctgcgcacctgcggcggccgactatttcgtgggccttgtacgccaccttgcagaagggaagctgtgaggttttggcgatagaagcgcatttacttgtgttttaaagcccacaaacgccgtagtgactaacttattcattcagcaaatgtctgtcagagcgtctattacgtaccaggcatgtagcctgaacttcacgcctgtcctcatggagcttgcagagcacctctgaaatacacaccacatacggaatggccatattttctgggttgtaaaatactttgaattgtaactccatatattgaatagattttcagtagtgagggaagaaacaatacatttagttcatataatccatatgtacgaaaaagaagtgctggtaattccagacatggaagtcagtaaaactaggagctaagaggtaataatcatagacattatgattctaagcctttgttaaacggttctaaaccagactgggtaagcgcacc

SEQ ID NO: 391733 - DNA, 356 bp, Homo sapiens
caacaaagtgagtggtagggagtggtgcttgggccaaggccagtgtggcacggaggttaagtgctccagagttgtgatctagtaggctagatttgaaacctgactcctctgcttacgggctatgtgatctgaagcaatttacctacctctctgaacctcagcttcttaaaataggaaaggaagatcataatatcttccctacgtaaaatcctcagcaaggttattccaaaactatcattattaggccaagggaatgcttcaaaaggaaaacaaaacaaaactaaactaacattaaatctaagcatttgttatctacagtgtttgccatgctagctaaaatctggaaacaacccatc

SEQ ID NO: 391734 - DNA, 304 bp, Homo sapiens
tgacaaataataattgcatatgtttatggagtaagatgtgattttttccatacacatatatgaagtgattaaatcagctaattaacatattaatcccctcaaatacataccacttctttgtggagagaatatttaaaatccttttttttttttttggctatggagtcttgctgtgttgtccaggctggagtgcagtggtgtgatctaggttcactgcaacctctgcctcctgggttcaagcgattctcccacctcagcctctggagtagctgggactacaggcgtgtgccaccttgcctagcta

SEQ ID NO: 391735 - DNA, 681 bp, Homo sapiens
atctttttgtcatccttaaatggatgtatttctgaagatctgggtatttgggtatcccaagatttgggaagatttataaaacaaaatcacacaaatacagaccatttggaaagggatggggagagatgttatgaatgataacaaaattagaattatataaaatataatctttaaatattttcaatcatcataattattagcacaaactaatagctaacaacatgcttctagggagatctcccttcctggaactagtgttaataaacagattttaaattatttataatttattatgttaacttgtttatttcttatgcctgtagttgttgacaataacagaaatagccatgttcaacagtgggctaggttccagctttagtgatcttttgtatgcaccaaattcttactgactttagcatagtcattttgtgctctgttgtcttatggtttatgttatcattctccagttactttgtgaatgagcactttatttcccctgagagttgtagagtttgtaacatgtttagggccatgcctctttcttcatttatatttcacatatgaatgatgtatatcctaactgaagattgggttcacaatagtgctgttgcacaaatactgagtaagtttaactgtctcttatttatacaattattacatttactattttatattcctcaa

SEQ ID NO: 391736 - DNA, 677 bp, Homo sapiens
gatctgtcaatgtgacaagctattccttgtatattcgcttagttcatgctgtaaattttaacaccagtggacaaattttctagttggactttaatgtaaaccatttgaataggaagtgacaataggaatgaagccacttaagatggcatcatttttctcttgagtagtctgtgctttcaaagattaggcaaattgtatttggagaagtgcagataccatatccttttccttatcatggaaggccacttaaggagtaagctgagattgcaagctatagtaatctttatagctatagtaatagctactttcattttgaaaagtaaaaaattagaccaattgtcgtaagaggctttctgtttatagtgtacattttggtatttaccacttagtttaacttctgaggtgtcagctaagaatgcaagatttaacaaaagtactacttacaaatggcagtggtatgcctttgttttttctctctcacctctccttctcaaaggtggtaacccctaagtgttcagatcataaacgagtgttctctttatgaaatagttactaggttagattcgtaaactggtctagaaatccagccacagttcaagttttctgggttgtttaaagtttcaactttaaagtttattaaacaacttacttccaaattaaagctgctgtataatggt

SEQ ID NO: 391737 - DNA, 450 bp, Homo sapiens
agtaaaaataaatgtgtctatggacccgcctggtagtaagttccctgccacccaaggacacatttgggatagataaacttagccattcacatcggtccccttaccctgtctcgacccagccagtattcaatcagaacacacactgtttgccacatggaattgtagatgctagtgccaccttcaaagatgtaaaagattcagaggggtggtgattcctatccaatgggtagctccccattgagttcacctgtttggctcctaaaaaaactgatggattggctaggcacagtggctcacacctgtaatcccagcattttgggagggcaaggcaggcacatcacgaggtcaagagatggagaccatcctggccaacatagtaaaaccccatttctactgaaaatacaaaaattagctgggcgtggtggaacgcactgtagtctcagctacttg

SEQ ID NO: 391738 - DNA, 669 bp, Homo sapiens
gaatatacaaagtgggagtctagggagaaatcgtctggtagaggagggcaaagagaaatctaggaagatgtttttaaaaatatggaatccttgaacaggacctggttttaaaggtttacttcagaattgaacatatttttttagtctagacctttaggggaaaaacttaaagctttcaggactcaaagacaagttactgttcccatggctaaattgcattccatatttatttgacaaatacttattgcaggtcgggtactgttttagccactggagatgcagtaagaaacttaattaattttttttttttttgagacagagtcttgctctgtcacccaggttggaatgcagtgacatgataacagcttgctgcagcttgacctccgtggctcaggccatactcccatctcagcttcccaagtagctaagactacaggtctgccccaccaccaccagctaatttttaaattttttgtggagactggagtctcactaagttgcccaggttggcctcaaactcctggcctcaagccatcctcccacttcggcctctcaaattgctgggattataggcatgagacaccacgcctggcccaacaaagttttaaaaatcactgtatttatgaagtttacattctagttgtggaaaccgacactaaacaaatagac

SEQ ID NO: 391739 - DNA, 715 bp, Homo sapiens
tattcccattttgtaattccttagcatcatgtcattgttcccataaaaatatactgtattttctgaaatgatacaatctatgaagcatttcccattacgtagacaccatgtctttaaattatagcaatttcttaagattttaaggcaaaatgagctcttagaagtgtgattaatagcagggaatgaggctaatgctgggtcatcagtggcactccattacaaaaaggttggtttaataaaagcattcatctttttgaccaataaagcatttgaatgatatgcttatagttcttatagtagttacttgctactaaataaactctgaacttgtattgtggaaaggcggcatgacttaagtggctgatgcacaagttttttgatggtgtgagaaaaggcaggcctggatgggaggctcattgttggagctactggtttttagggtgtcttctacaagcgtaatacccatgaactaggagcctcatttggtttgggggcaagtgtaaacaatctggcttcttggttgattatgtctttagcagtgtaagtgtccatgtagcccctcagtacgtgctttgtgaattgcactgttaggaatccagtgcttaagggtcaagattatagcgtggaggttcatgagggtctcttaagtctcctgtagctcagttgcccaatatatgagccttgtaccactcacagataggttgggagaggattt

SEQ ID NO: 391740 - DNA, 305 bp, Homo sapiens
gattaaatatcaacattataggtaaaaactactttataaattatagtatgtaagcaatacttccccttatctccatagtcatcttcaattctctggtttcttagtcattcatttatttgtccaaccatttatttatattatctcacttgctctgctattcctctaactggcatcttcaaaagcattttactacttccttctctcacattcatatttgcttttgtgttttcactcttccttatgtattttctttatgaatgaactctttgtcctctttatcactcagcctctcctatcgtctgttc

SEQ ID NO: 391741 - DNA, 461 bp, Homo sapiens
tgactttgatgctacatggaaacctaaaactttgtcactgaggcacaaaagatattcattttctggtggcaaaaaatttatcaccacaaaaaaatttgtctcagtgaggagatagttaagaaaaaaaatactcttctcctcccctggccatgtcaatcttattagtgacaaattaccctctcccacacactgtccttttgttttctaattatgactcctgctgtcagaatggagaatcagccacactggctcctgcctcagtggatgctcagacacatgcagattcctctatgcccttgtaaaatattctgcacaaaagaaataattctaaatcctaccatttttttttttgttgggagacagagtctcgctcggtggcccagggcgggagtgagggggggaatctcggatcatggccacctcggccccccaggtacaggtgattctccggcctcagcctc

SEQ ID NO: 391742 - DNA, 353 bp, Homo sapiens
gagaagaggatgtgccagcctgctctcaggaagcaggcggcgagggttctgatctggctactgttagtggtcaagaagacttttttatttttttcacttccttggcaatgtatatctcaccactgattatatctcccttccggcattgagaagttgaggaaattcaaagacagatttgaacccaggactagataacccagagaataaggccaaagaaaggcaggggtggctctaggaggctgtattctaaggcctacaattctctgggctgccttgacatctctgagcctcacagaggcccaagggcttaactgtgagttcctctgtgagttcccctgccctcaccaggcatg

SEQ ID NO: 391743 - DNA, 629 bp, Homo sapiens
cgaattccatccagcatatgcacagacaggaatggcaggcttctaaatgcaaagatgacgaaacggacagacacagctaacacaattttttaagttctacgcttaggttcaagtacatcaaatgcaaaaatatataggcagagataagcctaggagaaagggaataattaccagaacactaatcccaccatactgcatacaagccaagaacataaaatgaacctctcagtcttacccttcctgcaactgaggacccgcttgccggcactcagtaggacacgtgattaaaagtgtggcttgtgaggccaaactgcatggttctgaaacctggttctaccatttacaagctgtatgacattaggcaaattacttaccttctttaagccacagtttcctccttgagacaggtggacattaacagtactagctcatgaatttagtgggccgttgcaatgagttaatacacatcagctgttactaacatccaccatatattcccagaggggtacccaattctttggggtctcaatgacccttgtccttcaccctctagaaggcatgtcatcagagaataacaaacattatcttcaacttacttgatccagtgctgcatataatttaagtagtca

SEQ ID NO: 391744 - DNA, 140 bp, Homo sapiens
atccggcagagtgaaactaagggtttagttctggaggcattatgttggtggccgtgggaggaagtcagtcaatcatttagttctgctgagataagcttggacccagtcgaaagaaaggtaagtcagcggttgtgtgtgcg

SEQ ID NO: 391745 - DNA, 711 bp, Homo sapiens
agcggactggagacctgcaaagcagtgttgatagatcccattggtggggtagaaatatcactcttagctaagaaccacaaaccattttcagaattcataaatggaaaagttctttcaagaacaatatgaagaatattcctaatccagtggctccacatgcaaactttgcctcctgaccacccaaggcatcattttagtcaactacatctccttctggagcctaactttagaaaatgcttcccacattgtctcttttagaagacaattttgatacatgatgttagaggaaacaactacctcaacaagtttgaaactccttctagaaattgctcagcagcaacacatactgcttttccagtaaaagctcctatttgacaaaggcgaaactccttggccccacctggtggttgctgaatccagcaaattcaccttttgcatttaagaccctatcagaagctgtactttgtcctttgacatctatggagttatagacattgaatctccttcgatgatgaagtgaggtctcattccaagtgcttaagataatgaaacctgtatgaggacagatgatgcaacatcagcaatttttgcagtgctatgaatttcaggtggcgtcttaattcgaagtaggttacaagataaaatacgtgaaaaagatactccaaatttaaaacaggactttcatgcaataagcataaatgcttcctctct

SEQ ID NO: 391746 - DNA, 403 bp, Homo sapiens
gcactgctggggatacaagggtgacaaggcatagtccttgctcctaaggaaccagcacttagggaaaatatgactgctatacaagtaactataagaacatattttatttcattattttattttgagatggagtcttgctctggcacccaggcaggagggcagtggcgcgatctcggctcaccgcaacctctgcctcccaggttcaagcgattctcgtacctcagcctcccgggtagctgggattacaggcgtgcaccatcatgcccagctaatttttgtatttttagtagagacagggtttcgccacgttggccaggctggtctcgaactcctgacctcaggtgatctgcccaccttggcctcccaaagtgctgggattacaggcataagccaccgcgcccag

SEQ ID NO: 391747 - DNA, 346 bp, Homo sapiens
catgcacctgtaatcccagctactcgggaggctgagacagaagaatcccttgagcccgggaggcagaggttccattgagccgagattgcgtcattgcactccagcctgagcaacagagtgagattctgtctcaaaaaaataaaaataaaagaggccccagtaagctgccttgccccttccgccatgtaaggacacagctagaaggtgccatctacgaaccaggaaacaggctttcaccaaataccaaatctgccagcaccttgatcttaaacttcccagccaccagggcagtgagaaataaattgttgtttgcaagctgcccagtctggggtattttgttatagca

SEQ ID NO: 391748 - DNA, 356 bp, Homo sapiens
cgggaggtggaggttgcagtgagccgagatcgccccactgcactccagcctgggcaacagagtgaaactctgtctcaaaaaataaaggattggtccagttgatatgctggaataagatgagttcctaaagggcctcgtgacttacagattcccttccacctggactgattaaaaagccaacaagaaaagttatttgtcaaatatagaactgcgctactcgaagtgtggcccacagacctgcagcattagaagcctgttagaaacgtagaatctcagctccctgaattcagaccccctgaatcagagctacattctaaaaagcccccaggtgattatgtgctcgaaagttcaagaac

SEQ ID NO: 391749 - DNA, 492 bp, Homo sapiens
acaggtgtgcaccacttcacccagctagaggcaagttatttaacctctctgttgccttcgttttcctctgcaaccaagcaatgaggataataacagaaacctgttacttggagttgttggaagaattaaatgagttaattcatgtagtacttgtctgagtgcctggcacaaaggagtgtttcatatgcattggctgtgataatgattatttataggacagagagcacatgcagtccagggtcacctaaacgcctaactggtccagaatgcaagtgcgttggctgagggctgtgagggcacagcagatgaagcattgcattcttcaaggaagtcctcagggggaggcatttgagattggcacagccctggagaggctagctcaagtagaacaaacactgttggtgcaggcaagaggctgtcagagcacctgccacatttgcagaggaaggagccctctgacacttgagagggagcatgtggggcgcagggggc

SEQ ID NO: 391750 - DNA, 341 bp, Homo sapiens
tggggaatgtcacaaggtggcgcaaagactttgtttaactgctggattcctagctagcacctggaatacttgaagcccctttcaccttctccctctttgcaaactatggctcagctgcatctgtgccctcagttctggtccccagcttcccctgaatccccttcgtgctgttatttgggctttgtattggtacctaaccacattctacctgtagtgaaagctgaaggtcttggttcccactctaggtggtaagtttcttgagtggagcaccagctgcatatactttaaagcatattcttttctgtatttccagcaatgccaggcacaggacctctgagttg

SEQ ID NO: 391751 - DNA, 525 bp, Homo sapiens
tttcagggaggggggatccaaacagaatctagccattttcctgggctgagatcagcgatctggaagagttggcagtgagaaattgtgggaaaaaatagaagagagaaggtagatgcaccaagagaaagaatcagaatgccctgggacactgagtgctgatatgcactgcatgggagggaaatatctaagacgaaaaaaaaaaaaaaaatagaaaggaaaaaaaagaaaaagaaaaaaagaaaataagtagaaataagtagacaggaaattttctggggatcaaccagaactagtaatattttacattcccacctgtcaaaatggaaagacctcataatatatggggaatcaagtagagtccttcaaagcacaccacctggggaaaaataagtcccaggctaaaggttgccccaggcccattctaaacacttaaaaccaaaacaaaaatccaacactatttatagaaatacaacaaaatctaggaaccaacaaagtaaaattcagtgtttggtatccagaagaaga

SEQ ID NO: 391752 - DNA, 663 bp, Homo sapiens
tggacctcgggattcagttccctgggatccttctatggccttccacattttctcatcttttttcactgtggcaaatagagcagaggggcttttgcatctgcggtcctgtaatgtagagtgggtttctttcatagctgtttttgtttgttttatgcatttaaaagcactagtctcaagacaggtctagttttcaccagactgacagaggatccgtagcacagaaaaagggttaaaaacccaaaggagtcataatttgggggtgttggtaaataccagttattggagggtagagagctggcctttaaaacctgattgtggcatttagatgtggtcttgttttgaacgtttttacagctgagactgtttactaccccttaatttcatgattcaggttgctacaagttctgtctggaggagctagagttttccggccctaaatccataggaaaagctgctatagttcttggcctccggatatatagaatttgatggcaaggacaaaactttgttttattgcttttatttaagagtcagagcttgggtgtttgctcaacgaattactcaaggtcataggaattgaatgactggtgagaatgaaattcatgtatttaatatatatttattgtgaggctgctgtgtgctaggtgctggtgaattgtgagg

SEQ ID NO: 391753 - DNA, 584 bp, Homo sapiens
ttttatacaatgaagatacttttattttatcgtgattactcttttgccttttttgttggttagaggaaaaaagaatccttaaagatgagtgtgaaaatttgatttattttttaattcacaaaagctgaaagttgaacatgtagatgatttttcttttaagatagataattaaatatgtatagattatctcaatttctgtcatcttgtgcctgagagattgaaggaaaatctggaaataagaggcaaccacttcaaactttgcaacttcatgcatttggcaactgagccacttccaaatctgtagtttggtcatgaccttagttcttaaaagtcagagtggaatcctcatcttctggtctccttggattttcagttcagtaccacaaacttttgaaaaactactggtgggtttttgaaatgccagattgtgtgccatgatctttgctcttaggcagtttaaatttcgggagggatacatggcaatttattgtattcattcactcattcattcagcgcttattgctgggggctgtagaaacagaggtgatgaaaattagaaggcctgtttgaccgttgtggtggag

SEQ ID NO: 391754 - DNA, 340 bp, Homo sapiens
agtgaagagctcagctactggtagagtttgctgtcatttcctttttccatactaagacaccagctgttgcccacattccttttgccatatcagtacaaatgtgaacatggtggaaaaaggcagttaactttatagtattattatgaaaagaattatgactttagggacattctgaaggatgagcccagggttctgtggatcacagtttagaaaactgctgtcttacagaatccatttctcccctgttctgagagtgggcagtgcgagaatcttatgcctgtattaaatcatgactttttaatgtcctttcatattataagatgtaggtaaaatcaggcta

SEQ ID NO: 391755 - DNA, 394 bp, Homo sapiens
tatgtaatttgaggaaagctctactctcctttaggcagctgattagcaccttcctttaatctttttccaagcaacgtagtattaccacacatttgctgtttatgtgttaagagatgttccacctcactagtaattaaataaatgcaaattaaccaggttttttagtttttttattttttcaggtaggatctcactctggttgcccaggctggagtgcaatcgtgtgatcacggctcgctgcagccttgacctcccaggctcaggtgatcctcccacctcagcctcccaggtagctgggactataggcatacaccaccatgcccagctactttttaattttttttgtagagatggggtttcaccatgttgcccaggctggtctcaaacccctgga

SEQ ID NO: 391756 - DNA, 496 bp, Homo sapiens
tgatgacaaaaattttaattttacatagaagaaatagacacaaatggagatgtacctattttggtaaacacaattctgagtaacaaagcttacctaagagatggattcttttaataccaatgtcttctggaattttctttcttatgaaagggactctttcagaatgcttccctcatatagttataggcattacataaaggaaaccatttttttttagtagtggcacaaaaatattttaaaatagctacttctaattacctacactagtcataacagattacggcaatataaatgaaaccgtagtggaaagatctaacatccatggaaatttaaaacaatgagaaatggaactattacaaaaaattacctcctatacattctttctcaagaacttcctggaggacttgctccaaaaaatgagacggcaaattaaggaaaaaaacaaaagattaagaaacatgagtttcaacataggagaaaggaaatcgtcatgtaa

SEQ ID NO: 391757 - DNA, 452 bp, Homo sapiens
caaatattcaaattaagtgagataaacaaagactgtaaatagactcgtgtttattcaggtcagggtttgctatcacatgagtttaggtgctaaacttaggaaagcatttttagttttcagagttttgtacataagggatagtcaacctttctagagagcaatttgacaatatatattaagaatcttataatgtatataccctttcacccaaaatcttctagaaattagttataaggagataattatgattgcatgcaaaaatctagaaataagaatgttcaccacagcatcgtttttttgtttgaaaacaaaaccaaaaaccaaaaaaaaaaaataatctaaatgtctaccagtaggggattctttaaataaatatagtgcatccatacaataaaattggaaggagtcggccgggcgcggtggctcacgcctgtaatcccagcactttggga

SEQ ID NO: 391758 - DNA, 303 bp, Homo sapiens
gtcactcaataaatacagaatgaacaaatatttggtgaatgctacaaaagagctaagtatgaaacacacatcaggagaacctaacccagttcggggggaccaagccttctggggaagtatcatctcaagctaagatttgaaggacaaggaggagtcagtcaagtggggaggacaagggataggtggaggagagaatggttcctgcacaggagaattgcttgaacctgggaggtggaggtttcggtgagccgagatcgtgtcactacactccagcttgggggcgacagagcaagactccacctc

SEQ ID NO: 391759 - DNA, 746 bp, Homo sapiens
cgcagtggctcacgcctgtaatcccagcactttgggaggccgaggtgggtggatcacgaggtcaggagatcgagaccgtcctggctaacacggtgaaaccccatctctactaaaaacacaaaaaattagctgggcgtagtgtcgggcgcctgtaatcccagctactcgggaggctgaggcaggaaaatggcgtgaacccgggaggcggagcctgcagtgagccgagatcacgccactgcactccagcctgggcgactaagcgagaagataaacaattttaatcttagatgcaactaataatgtcctagaaatacataaggcgaaaattgacaggacaaggaaaattcacaaatctgcatagaggaatagtgtaatacacctttgtcagtaattaaggtatcaatctgacaactgaaatcagcaaaaatatagaagatttgacaatataactaataaacttgcactaatgcacaaatacagaacactgcaggtatctacaaaagaaaacttattcttttagccaaagaacaattactaaagttcactacaaaaagaaagacatttcaaaggatgagtaacataaaaccagtatctctatatatttaactgcactacaatcaaagtagaaaccaatactaaaaaataagaaaatcactacattagaaacaacttctaattatgaactcataaagaaaatattcagaactgaaaaacagtaaatactatatactaaaatttgagagatg

SEQ ID NO: 391760 - DNA, 359 bp, Homo sapiens
aaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctg

SEQ ID NO: 391761 - DNA, 602 bp, Homo sapiens
tgtaaatcttatttactaaagtaggagttatgagagattcatttcttggcttaaggcttttaaaatcttaatgacatgtgtcattgtagtctaagatctggaagaaatattaattctcaaatgaatatatcctatgggaggcaactagtggtttagtttggaatgtcactcccatctctcttcatcctcagggctattgatctcacaccagtcacatccaatctctctctcctaattgcttattggtttcttccgcctttctgtcatcagcatagctgagttccttggtttgaatcagacactaaaacttttttatttcattctgctatcaaatcttattaacacctcttcttctttttgctaattatcagatttttctatctgtcacttaacttcctcagccatgtaatcccatatccagtgttatcaaacaagatttaatttggctttcccttcctcaccttaaactctctgagttcaaaagttaacttatctcccttttgttagtttattttaattaagacaagtcacattctgagagaagacaatcatttaacaaaggaccagtatctcgaatatctgaaaaacctttacaaaaaaaa

SEQ ID NO: 391762 - DNA, 500 bp, Homo sapiens
cggctggtggggccaattcctcacaggacacccacagatactcatccgcagccgggggatgggggacccctggttctttatcatattaggagcacggctttctaactctaggtttactaagcagttttaaagtacatacgatacattgaagtggatactaaagttttatcagaactttaatacgtgcatctctgtgagacgctcaataagatttgtctggatgttctcaatatttaaccaactgtggcattccatagaataaactttacttcccaatttatggctcagtttttcttttttttttctgagatggagtcttgctctgtcacccaggctggagtgtggtagcacgatctcagctcactgcaacctctacctcccaggttcaagcaattctcctgcctcagcctcccaagtagctgggattacaggtgtgtgccaccatgcctggctaatttttgtatttttagtagagacggggtttcaccatgttggctagg

SEQ ID NO: 391763 - DNA, 404 bp, Homo sapiens
gccctttcattgtgatcatggtgtctgagggagagaaaggtcagccagaggccgtcccaatggactcagggaagctgcagggagaacccaggcaaagtaattaacactggagggaggaaagctttcagctaacggtgcagagctggggagatgggacatgaggacatccactaggaaccagctctcatcacactacacttaatttttcttcatctttctgaagatggttccgagaattactgctgataatatgttcaaaagtccaaagtctgtaaaatctagtaaccaaatataattatgcaaagagacaatacactactttttaaaacagtcccttgaaaagcggggcaggaacagttctgacatgtcctaaaggcaagagggacattgtgtgccaatacaca

SEQ ID NO: 391764 - DNA, 441 bp, Homo sapiens
agtcccccgcatcaagctccatggccttaattactcagtccttggtctaaggagacacatagatacctgtgttctcctccatttaacagccagggaccagccactgtgtgatttttagaactcagtgttttacactgactttgagatatctcagagacaaaccttcggtccaccaacagcaagtgtttacgtcctcgaggaaggcattttaaactaaccttattcatctcgtttttcttacccatgtttttctttctccaaaattattttttgggcactttagatataagctgccttatatcctctttaagacaatagataaacaaagcaagcaaactccttgataccttcaattaaatctcatgtaaaccaaaccaacacctctggggtcattatatactcatggccacaacactccacagttgtgctgatggggcaggt

SEQ ID NO: 391765 - DNA, 248 bp, Homo sapiens
aaaacccctgttctaaatgatgccggcagggaggtacttgggaaatctcagatccaatcctgaaggcagacaaaggttgcagaagaaaggagggatttaggatcagatttacgaacagaaactgtggttccataatgtaccagctgtttacccttgaacaagtcatttgacctttctgggcttccgtttccaaagtgactggtgtagggagggctcatttccagcatcaaagggagatttggctcttc

SEQ ID NO: 391766 - DNA, 827 bp, Homo sapiens
tgtttaaagtacagctgtatgacttctaaatcatgccctgttttttccctgcatgttacttaccacttaaatttccctgaataatgttagcactttgaaaagggcccaggcatctagcctcatgtcgttgtttcatagctgaggaaactcaggcctagaaagtttcaagtgacttgctcaaggttgcataatagtctgtggctcccaatttctaacatctaaaccttgcttctatactacatactttgtcaaacaatttttaaaaaattcttgtgattgttctaagtgctgattcttttgctctgaattatcataataactttttccttaagttctacttaaagcatattattttacttaaatttttgtatgtgtaaacttaattgagttgtcatgggtaagaacagtacatctcttttgattctattgttgaacctacaatcaaaccatctatagctatccctgtggattattttcctttgtcctcagagttactaacctgagactctgatttgttcaaccctccacccaacctacagaatcacttatactgtagaaggtagaatctaatgcattgttcttcctttcaagaaggttttgttgagtttttcttttatttgtttgtatttaaaaatatcagttttttttaatatgaagttagaacataatattaaatattcttttccatatacacatgcgccctctttatcccctttccacatcccagttttggtaaaatacctatcccctttttctttattgagaaactatctcatagattgtctgtatcctatgtcctattttcctcccagaaacacaccagacaa

SEQ ID NO: 391767 - DNA, 358 bp, Homo sapiens
atctcttctacctgctttcctaactcttctgtagttcctttgccttgagggctttcaagtcagggaagcagtaatccctggtttctttcctgtcttctagactctaattcctgctctgggctctaatctctttttttccatactctagtttctctaaatgcctttttcttctctaagaagaagaaggtgtcctaaagccactgtgatttatttaccctattctctcctcacgtcacagtcgggctgtgagactgttgcagacatagtcaaaggagaaaataaagttatgagtatatgtgttaacttacttccttttcctctgctatagagctgtactttggagctggttcacctggca

SEQ ID NO: 391768 - DNA, 463 bp, Homo sapiens
tctcatctccatgtcataattacaaccaaaatcctaaagggactgatttaccacactgtgggtgccataaggcccaatttttaccctcagcagcagctgtaacatcccaagttacagttctaccctccaaagatgtgcctgaggcttgtgcctgccatactaacatgttaatatgtccaaagcttcctgcagagctgtgtcccagtcccaaagtgcccctttctaataagtctatatattggtctcaaacattggactcagtgtcagataaatgctctccaataatccaaagactaacaaatgtctggatttcttttctccttttttttttctttaagaaacatagtatggctctgtttcccaggctagagtgcagtggtgggatcatagctcactgcagaaactcctaggcccaagggattctcctgcctcagcctcccaagtagctgggaataaaggcaca

SEQ ID NO: 391769 - DNA, 1570 bp, Homo sapiens
acatttgacaagtgaaccgcggccccaattggcaataaaactggtgacattgattcccaacccaccctggtaaaatcttgcgcccaaggtgaatacataattccctttgaaagatagaatagtggggcccaactttttcaacccccccccagggactgttacgctgttgcccaaatgttttgtgttaaaccccgaatatattcccccgttcatcgcaggtatattcttcaacaaacattaaaatatttatcaaactgtgcccccaagtataccaccggaagcgcaccatttactttctttaagtgtgaccccttaattcttagaaaccatggcccagctttgttgaacccctttaacctaccctatggaaaaagcaccctggtttataaaaaaggtgtgccccaacagtaatggtaaatctggggcacaaaaaggtcacaagtgggcccggagttattttaccggaccaggatgttctactaagttgttggaaggtccgcccaatcttttgtagtcgttgtataccccccggtttttgcacgggtcctaaacacccaccccggggtgaatttaaatgggcaccacggattatggtcccgtgggcggtccaagcgcttgtaccagaaaaacgtatgtttcgcgtcaaatccccccccccttttttgttaaaaaaaaacccgattaaacccccttaggctaaagaatttttaacccccggttcttccaaatttaaaaaaaaaaaaaaaaaaaaaaagacaggcccagggactgactacaaattgacttgttaaaaggtgcacagtctttatagccttgttttgtgttgatggtggggtttttctccccctttcattatacctgagaagtatgagaaaggaagccacaaatttgaagggccttataaatacctttcacaaaatggcaccatgggcatgtgggaactttctggggtgctgaaaacagtgtatgtctctatcttagaggcacggatgtgggcaaatagctatgtgaaaattacccatctgcacggctaagatttgtgcacttaactatacatgagttccatctaaattttaaaataaattagccagtgacctaggggcaactagaggagaaggactcttccagcttggaaagagtaaacaaaggtaggttgttgtctcaaagcctgctttatatcttgttctacattaggaaattgcagtgtggctgcagtttttaatggatttccttggcagaagaaaatgactgcaattctggaatcagagggttaaggtggaggagaaggaagcaactcatggcccagcagtcttctttagggtttcattttcatctggtaccactccctttccaatcctacagcacaccagagtgaactgtctttgtatactggggctgtttccattgaacacactcaaccactacatcccaaggggctagtaccatgactggcattccataagaacttgatatatgttgaataaaacaatcctttaaaaaaaatcttaaagcaagacaagtcactagaacaaagaaagagaggaaataaagatttaaaaacacctccaac

SEQ ID NO: 391770 - DNA, 1629 bp, Homo sapiens
acacaataaactttaaaatacatttccatttttaatttaaaaaataaataacagcaaatctgaacaaaattttcctacttcaatgcacatcttcctaactgtccatgtttgaaatccagatagcaacaaaatcatggcaaaggcatttttgacaaagtttagacaaacgactcacaaaatatggctaatagtagatgagtttggacatctgatactgcagaccagccttggctagatcctaggcgtcagagtgaaatcatgaatttccttttgtagattagaattgatggtccaactctcaacccaccaaagagaaacttaccttttccaatttaattgtaaaagccagatatatcactgaatgaaggtatctaaggaagtgatatttatcaacttcccaaatgatacagagaaggaaagcataattattaaaatgaacctaaagtctagatacagtgggccaggctggtgaagccttagactactatggaaatgacattgtttataagatgttgcacaaattatggtaatctgtgtcaatatttcaatgtgtgctggattattactgacatattcataattttaatgtccacaaatctttttatcttaatagccagggtatggcagggtcaaagcaccacctgggatgataaatgggacaagtatagtccatggacctcaaagcctttgtacagaaaactagtttccttcagatcctccccctctttttgtttaaataaaaagcagaataaaagcagctagggctgaaggaattctaaacctcaggtagcttcaaaattaaaaaaaaaaaaagacaggcccagggactgactacaaattgacttgttaaaaggtgcacagtctttatagccttgttttgtgttgatggtggggtttttctccccctttcattatacctgagaagtatgagaaaggaagccacaaatttgaagggccttataaatacctttcacaaaatggcaccatgggcatgtgggaactttctggggtgctgaaaacagtgtatgtctctatcttagaggcacggatgtgggcaaatagctatgtgaaaattacccatctgcacggctaagatttgtgcacttaactatacatgagttccatctaaattttaaaataaattagccagtgacctaggggcaactagaggagaaggactcttccagcttggaaagagtaaacaaaggtaggttgttgtctcaaagcctgctttatatcttgttctacattaggaaattgcagtgtggctgcagtttttaatggatttccttggcagaagaaaatgactgcaattctggaatcagagggttaaggtggaggagaaggaagcaactcatggcccagcagtcttctttagggtttcattttcatctggtaccactccctttccaatcctacagcacaccagagtgaactgtctttgtatactggggctgtttccattgaacacactcaaccactacatcccaaggggctagtaccatgactggcattccataagaacttgatatatgttgaataaaacaatcctttaaaaaaaatcttaaagcaagacaagtcactagaacaaagaaagagaggaaataaagatttaaaaacacctccaac

SEQ ID NO: 391771 - DNA, 369 bp, Homo sapiens
aagggtgcgctgcgtggagatgacagttgaggagatgaaggagactgagaatgggacacagttggcgcctcttcccatggagggagtggacattcgcccaaacaggaggaaggcatgctgaaggtcatcgagagagggcacaggtacagagatgcccatgattggggactgaatctttgtccactacactggctggctgttagatggcacaaactttgaccccagtctggatcacaaggacaaattctcctttgacctgggaaaaggggaggtcaacaaggcttgggacattgccatagcagccatgaaggcaggggaggtgtgccatatcacctgcaaaccagaatatgccttcggtgcagcaggcag

SEQ ID NO: 391772 - DNA, 370 bp, Homo sapiens
aggccgaggcgggcggatcatctgaagtcaggagttggagatcaaccagaccaatatggtgaaaccccatctatactaaaaatacaaaaattagccaggtgtggggtgggagaacacagcagggaagcacaggcccctggtggaagcacagagctattttaaaggacaggcagggcccttctgagccccacagggaaattaagcagcctgattctcaggctcaagagccaaggtggaggccagaatgcaaggctgcaggtgggctctggctcactgggtgctggggctctggcccgtgcaggaggggaaaacaatccaggtctatggggaaacagcttcaaagccgagatggttaccagtggaaaagcaa

SEQ ID NO: 391773 - DNA, 260 bp, Homo sapiens
tgtctccacgtgctcagctctctgaacactgtcctcttgggttttctctcccttccttcctgccttccttccttccttcctctttccttcttctttccttttcccttcctttcgtttccttttcttttttcttttcctttctctttctttctttttcttttctttccttctttccttccttcctcctttcttttcctgtcctttccttccttttattttcctttccttttctttctctttctctttctctctttctttct

SEQ ID NO: 391774 - DNA, 576 bp, Homo sapiens
ttcccaaggaccatgaaactcctgctgctggctcttcctatgcttgtgctcctaccccaagtgatcccagcctatagtggtgaaaaaaaatgctggaacagatcagggcactgcaggaaacaatgcaaagatggagaagcagtgaaagatacatgcaaaaatcttcgagcttgctgcattccatccaatgaagaccacaggcgagttcctgcgacatctcccacacccttgagtgactcaacaccaggaattattgatgatattttaacagtaaggttcacgacagactactttgaagtaagcagcaagaaagatatggttgaagagtctgaggcgggaaggggaactgagacctctcttccaaatgttcaccatagctcatgacttcctctcggctatcactcacccctgtcctcagagtgataaactaagtcacatacagataaagcactgaaaacaccacagtgaccctcccaccccccaccaatatgtaattctattaatagaaacagctgtgtaaagaagtctaaaattttcactatttccaatgataaactcttcagtgctcttcttgaa

SEQ ID NO: 391775 - DNA, 373 bp, Homo sapiens
tagtagaaacggggtttcactatgatggccaggctgtgaattgcctattcttatcttctgcacatttgtctattgtcggtctttttctcgtcgatttacaagcattccttttttcattctgaatattaatccattgctttctgatgctgtaactaagtcctcctagtggtttgtcttcttggttaagccagatgttaacttggatttttcctgcataaaactgaagactcaagatgcatcaagcactgtatacagaaaagtgctgcgtatcctacagaaagctacagacagttgggggtcagaatcattcggattgtttcaagtttggggctattataaataaagctgctataaacgtttgcacacaggtttc

SEQ ID NO: 391776 - DNA, 405 bp, Homo sapiens
ttgatctcctgacctcgtgatccacctgcctcggcctcccaaagtgctgggattgcaggcgtgaaccgccatgcccggccctatagtttctatccaacttactgtcattagtgatgccttttattacagaaatactaatatatttgattaacgtgcttctgattaaataaaaattcccactggaattttatttaatatatagtatatataccataatacctttctaaaatctgaaatattttgaattccaaaacataactggccccaacactgttagataagggtatatggacctgtattattaccttcattgtacagatgaggaaactgaggcaggagaatcgcttgaacccaggagacggaggttgccatgagccaagatcgcgccactgcactccagcctgg

SEQ ID NO: 391777 - DNA, 523 bp, Homo sapiens
ttgtagcacttttgtactttgtagcataacaagatgataaggcccatctcatgcctaccctgctttgggcttggttgtgtgttgatttttttggtagacaatttcaccatgaaccagacgccgtgtcaaagagtggatgccaaggaagcatgtttcattcgcagttgttggcagcagcatccttttatggataaagaacaggcagccaacagacctctctttgctgagttccaggtgtccctgatcggcttaaacactgggtcatataatgttctttggtaaaatgaggagggtcatgtagacctaaggatcgttcttatccgtgatacgaagatgattttgtgtttgagatagttttttcatctcccacttctaaaatggatcatttaaatattgccatttgttgtggtgattggtatacttggctgacaggtttttgtttttccaaagtaaagactgtggacattagcacacatttcaagtatttgatacttagcaaagggaagcttcctttaaaaaaaaa

SEQ ID NO: 391778 - DNA, 379 bp, Homo sapiens
aagagtgatgtgggggagccttgggcaacagtgctgccgagctggtgccatggactggtacatccttctggggtctaactgcatcccctgggccccagtagagccgtcactgactgtgcagtggcaggagctgctgtctgtcgggcacttacccaacatcaggcactgattttatctctgatctttagcattggtcgatatcattcaacaggcttatacatcatggaacctaggcccagtgaggttcagggcatccaggaagtaagtggcagaactggaattcagcttggatctgtgttttcattttgttttgttttgttttgagacaaggtctggctctatcacccaggctggagtgcagtggtatgatcttggctca

SEQ ID NO: 391779 - DNA, 539 bp, Homo sapiens
caagtgagctccctctctgtcaaaaactctgcaagcaattttttcctctccttctaatattaaattgtttctgagtttgtcaaatactcacaagggaagttttctacgacattgatgtgggtcaacagcaagtccatgtccctgggttctgtttgcagaggaggattcctttcccatctgtcagggcaatgctgtggaattccaaagcccactgtctacggaacagccagcccattactggacatcaaaatgcctggacttctgagctccaaagggcatcaggagatgggggagccgcagagaccacaaagccccagctctcagctcccacgtcctcaccgcaccccaaagacagggaatgtcatgcgccgggttgggtcagaataaggaaaggttagaaactcttattttcaaaatagtctagccacagttttcttaatgaatgcctttatcagatttcatttgaagaaaaggtcttctgctttaaaaaggctgctcttgttcagtccattcgcttttcaaacaacaaaactgaggcc

SEQ ID NO: 391780 - DNA, 263 bp, Homo sapiens
tcctctagggtgccattagcacttatttatggctctttcagcacatatactacagtgaaatccaactcttctgctaatttgtgagagcattctttctatatctgtgcacatcctagattctcaattaaacatttattcaattcactgtactttcacttatttatgcttttttgatgaccccaacataactgttcttttctagtcatgataaatgattaaatgatactcaatgtttcaagaaatgacactcaacgactaaatga

SEQ ID NO: 391781 - DNA, 386 bp, Homo sapiens
gagaaggggaatgctgtcgtggactagagggccagggaggccctggcccagggggctgaagctggctcatgacagaaggaatatcacccaaccctcggggcccaacccccatcctgtcctggacactgtggctgttttcaaagtattattgttgaaacatttattgatgtgaggccagagttcccatccaatttatttcaggtatcaggatgggttatttcaggtcttcagatgccctctgatgagagggtagggcaggggaagaacagtgtgagagagagcctaggtctagcctggcaagcattcaaattccagactcgcctacccctgaccccacactgagccctgacacttgtcacagactcagccctgatcctggccattct

SEQ ID NO: 391782 - DNA, 317 bp, Homo sapiens
cttttatccagtgcattgtcacccattattacctgctagatttttaactctgatagtaatagtgctttaaatatttaaaatattaagtaaatttaactaatgagaactccagttgagaaataattcatatgatctgcttgtaaaaatcagaaactaattcaaataattttaagtaaaacaaaattgatgggagggtaggtattgagtaggagtatcctgtataattcaaaggtgctcagagtttggaactaggagaaaggaagttaagaactaaggttactttccccatttatcaaagggctacacagtgctttatt

SEQ ID NO: 391783 - DNA, 401 bp, Homo sapiens
ctgttattcagagaatggtgtaatcagttaataggatctatatttattttatagtctatattttaattatttattataaagtggcaacagtaaatatctgcctcacttatcttgtataaatatgaggacaatttgtgtattttctggagggacattttgagttcatcagaaggaagacactgaaaaattccacatggtactatatactcccattaggcattttagaatttaaggctataatttaaaactattattgattattctaattctataggactgaaaaggcatttgcagaaatactctcattttcctgtttctatttctgtttatacggaacaaataacttatttatttaggctttcctatgttctctgggccattgataagggtcacaaaatatt

SEQ ID NO: 391784 - DNA, 207 bp, Homo sapiens
cagttaagacagggtttcaccatgttggccaagttggtctcaaactcctgacctcaggtgatccacctgccttggcctcctaaaatgctaggattacaggcatgagccactgcacctgtcctcaagtccctactttcaatgtgctttcccacccaacagccagcacctatggctctttttgggagggctgcacttgcttcacccttt

SEQ ID NO: 391785 - DNA, 396 bp, Homo sapiens
ttttgtttgtaggttacatgtccgaataccagcactcttgatagaagtgctacaaatgagaggtactaaagtagtttctggaagaaaatccaatttctactatgcgataatacggtttgatcatcaggaaggaaaaaaaaagttgtaaaccactgattccaaggatttttctcttcatcaagttctttctccttgttctacaatagccaatttaaagcatctgccttatgaattatcagccaatatttactggataaaaatgatacttattttcaggtacaaaggaaagagtcacagttaagcaaatgtagttctgggctgggcgcggtggctcacgcctgtaatcccagcactttgggaggccaaggtgggcagatcacgaggtcgagagaccat

SEQ ID NO: 391786 - DNA, 182 bp, Homo sapiens
tggtctcagaaggcagcctgccttcaaggagacaccacaggaaccatggtcaccaaaccctggatgggcccaggaaggaccaagctctgtcctgtagcagattggagcccagcaaggtctttttgagagagacttttttgggcaagggggatggtctgtgaccaaggaggtggacaaggcag

SEQ ID NO: 391787 - DNA, 178 bp, Homo sapiens
ttgttacaaatctaagaatgttaagaggtagcacaatatgaccctcaaaacagaaaatagatatcatcctaagggaaaacgtagtaccagaagaaataatccaaagtctattggttgaacacttacacgtgattatggagagcttctattattaaaattattatcaaaattgtctttg

SEQ ID NO: 391788 - DNA, 354 bp, Homo sapiens
ggtcttactgtgttgcccagactggacttgaacccctgggctcaagtgatcctcccacctcagcctccatagctgggacattcaggtgcatgccaccgcaccagcttaccagttttaatgaggttctagataggttaatagataggttaaacagcccataacagtaattcttaaacattttcaatagggtaattgcaattttgtttatggtttggaaagagcaatcataaaattgtattaagttcttgagataattataaaatctatgattgctccattcaatccttcaaacacaatgatggttttcttagaataagcaattctggtcattatgaaataaagatccagatccaa

SEQ ID NO: 391789 - DNA, 445 bp, Homo sapiens
acctcagaatctgtaggtttttaaattaatatacactcttctacccagattcaggaactgccaaaatagggatgacccttctctctggcctgtgctttcttgtgattctcttaattacagtaggaggaagttcgagaacactgagacaggaactggtcagaggaattttactgtcccattattccctatccaagaagatgctaaatcaaacttgtacactatctgtcctgcttccagcccttcttcaaaggtgggatttccataatcctcagccaactttatgagcatgatctggtgattgcttagagatttgggagaaaaagtagcagagaagaagagttctgactgctcttatcacttcctgttgcacagaaactgtgggtcagaggtgataccaatctttttatcatctgagacatgtaaagtgctcatatccaactgatct

SEQ ID NO: 391790 - DNA, 843 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggccaatatcattggggatcgggttatggggatccagtggggggaatgaatagttcttctggaaggatatggcccttgcccactaaagaagaccctttagtgcgcacttcggtaactaagaaccggtttg

SEQ ID NO: 391791 - DNA, 1105 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagatctgattgttttatttggcagcccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391792 - DNA, 865 bp, Homo sapiens
  misc_feature (8)..(8): n is a, c, g, or t
aatttccntccactcgctccctaataacctacatcattattatggatgctgatctctcacaccatccaaaatttattcctgaatttattgaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacaggtgtgagccaccgcgcctagccagatctgattgttttatttggcagcccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391793 - DNA, 847 bp, Homo sapiens
  misc_feature (740)..(740): n is a, c, g, or t
  misc_feature (756)..(758): n is a, c, g, or t
  misc_feature (762)..(762): n is a, c, g, or t
  misc_feature (769)..(769): n is a, c, g, or t
  misc_feature (777)..(777): n is a, c, g, or t
  misc_feature (783)..(783): n is a, c, g, or t
  misc_feature (787)..(788): n is a, c, g, or t
  misc_feature (800)..(800): n is a, c, g, or t
  misc_feature (804)..(804): n is a, c, g, or t
  misc_feature (806)..(806): n is a, c, g, or t
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttgcnccactaaagaagaacnnnttangtcgccntcgttacntgaaancggnngttggtaaggcncagnanaaaagggggcccgcttttgacccttttttaaaataggggga

SEQ ID NO: 391794 - DNA, 1347 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaaaacacaacgggccccattggtctcaacgttgcacctctgcctacggtctcctttatgaggcgtgttcgccgacattccctcactgcccacccgccctccccccttcgccggcccctcttctccatcctgtcttccggcgcctatacccccatctcctcatccctgcctccctactgccagccccctcaccccacaccccatccgctctagttaccatacgttggcctggccactccccgcccccctcgcacaccctgcccccac

SEQ ID NO: 391795 - DNA, 1113 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaaactaaattactcacactggcggccgcgatc

SEQ ID NO: 391796 - DNA, 1370 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaaaaaaaacaaaaaacaaaaaaacaaaacaaaccccaacaccaaaaaaaaaaccaaaacaaaaaaacaaaacactcgccctctttgccctaagggggggacctttgggccctttcccttttggggggggtaaattcaggacccccgtcccttaattccctgccctcgggctttccctcgcgggcaccggtctccctatcccaaggggggaataccgtttttccccaaatccggggaacaccgcaccaaacacaccgtccccaagggcccccaaaaggcccgaacacctt

SEQ ID NO: 391797 - DNA, 1163 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391798 - DNA, 1056 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatgaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391799 - DNA, 1187 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacaggtgtgagccaccgcgcctagccagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391800 - DNA, 1013 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391801 - DNA, 1024 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391802 - DNA, 1244 bp, Homo sapiens
  misc_feature (1230)..(1230): n is a, c, g, or t
  misc_feature (1232)..(1232): n is a, c, g, or t
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaaaagtattgctgccttcattagagtatgtgaatgtagaattttttacatggggaataatttgaaatagtctttttaaaaactggaatcatagatctttatacctaattgatctcagaagtaagataatgttaactgatgaaatgtttatggctgtgtctgtatgaattgaaaaagaaatacacacctctgccctttccttaaaaaaaaaaaatcggncntcgtggcctcaa

SEQ ID NO: 391803 - DNA, 400 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattttctaattactcacgagagtaatatttgtaccttgggaccccttatcatttatggtatgattcatgcctcacggaactaacgtcttatttttggattgctagc

SEQ ID NO: 391804 - DNA, 446 bp, Homo sapiens
aaagtattgctgccttcattagagtatgtgaatgtagaattttttacatggggaataatttgaaatagtctttttaaaaactggaatcatagatctttatacctaattgatctcagaagtaagataatgttaactgatgaaatgtttatggctgtgtctgtatgaattgaaaaagaaatacacacctctgccctttccttaaaaatgtatctcaaatttcttaaactagaaaatacatttagagcaggcatttacagttcggttcttttcagctgttgaattgatgaaacatttcatctatcaaagcaggtctatttaaaatgcatattgtgaattgggaaacaatttgacagcagttgattacatagccgtttttttctcttttgagcaataacctctatcagtaaggaaaaatattaatgacactgaggcagaaacttagctgc

SEQ ID NO: 391805 - DNA, 497 bp, Homo sapiens
tcccctaattttatacttactttaaggacctctgttgtaggactaatcctatttctgttgtgttggtaatgtggtataccggctaagctgcctaattgtttttaaagactaacgttacttttttttttttaaactaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatattttttttt

SEQ ID NO: 391806 - DNA, 1082 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391807 - DNA, 737 bp, Homo sapiens
  misc_feature (8)..(8): n is a, c, g, or t
aatttccntccactcgctccctaataacctacatcattattatggatgctgatctctcacaccatccaaaatttattcctgaatttattgaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391808 - DNA, 892 bp, Homo sapiens
gatcgtgtttatggtgaatccaagttgggaggaaatgatattggaacctcgcccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaaaaaaaacaaaaaacaaaaaaacaaaacaaaccccaacaccaaaaaaaaaaccaaaacaaaaaaacaaaacactcgccctctttgccctaagggggggacctttgggccctttcccttttggggggggtaaattcaggacccccgtcccttaattccctgccctcgggctttccctcgcgggcaccggtctccctatcccaaggggggaataccgtttttccccaaatccggggaacaccgcaccaaacacaccgtccccaagggcccccaaaaggcccgaacacctt

SEQ ID NO: 391809 - DNA, 1147 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaccccaccacaaccacacctacacacgaaccactccccacatcaccccccgcctcgtttggcctca

SEQ ID NO: 391810 - DNA, 1108 bp, Homo sapiens
  misc_feature (1094)..(1094): n is a, c, g, or t
  misc_feature (1096)..(1096): n is a, c, g, or t
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaaaaaaaaatcggncntcgtggcctcaa

SEQ ID NO: 391811 - DNA, 1067 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgagggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaa

SEQ ID NO: 391812 - DNA, 427 bp, Homo sapiens
cgtaattcggcttccggcatctggctgagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatgtaagtggtatgtttcttt

SEQ ID NO: 391813 - DNA, 425 bp, Homo sapiens
catggataagttctttagtggtgatttctgagattttggtgtacccatcacctgaggagtatacactgtacccaatgtgtaatctctcatctatcactcctctgctactctttctccctagtccccagagttcatgatatcattcatatgccttcgcaacctcataaataatttttaatttttttcagacaaaatatagctacgttacatatgtgtaatcttgatatatttaaaaatgcaatgcattttgaggttaaaagatgacataatgataaacatcttcaaccacacactctctatataagggaattacggcccagagagattaaacactgcattagctcacataatcatcagaggacctgaaatgagagcaaaggttcttcatgtcatgcctaatgataatatattccccactgtgcttc

SEQ ID NO: 391814 - DNA, 679 bp, Homo sapiens
tatgaaatcttttaaaaatatctaggatctgctatacttatgttgaatatataagttgggcttcctagcttcagataacagtgaaatttgcttatatttatttcacatccagttgaataatgacttaatgacattgaaatgaaataaaacttctagatattttaatgtatgtgtatatgtctgacgctaaatgtaagccaatatatcccacattttagtgtacataagaattaccccgaaatgcaaattgaaatccaggttcctgagcatcacctctaacctcctctatctgtgtcttggagaggttaaaggaatctgcccttttcttcccgagtacttttttgagagaaaatacaaacagaaaaatacatacatcttagctgtataactcagtgactttgcatatgaaaactccggcatcatcaccacttaaatcaagatgtaagaacatttccatcatctctggagaattcttttgtgcttctttctggtcggtactgccatgcctagtccccactccccccccactcctttctcaagtgactactattctgatttctgtcaccatactgatattcttatggcagtgatctgtcagtcatatgataaatagtgccctatgtacttttcagctcttattttagatggtggaataccctgaaatattatgtgcaagatg

SEQ ID NO: 391815 - DNA, 424 bp, Homo sapiens
gactcaacatcccctgggagggtcacagcatctcctaaattctattcaattcgctctgcacgtactgagcacctgctttatgccattaccttgcttctaactatggcttaggaaagaacaagactcgcccctgagtttgaggaactatctattagagccatgagacagatacatcagatacaaacaaatcagcaggaacaatagaaacctgtaaattagtactgaccaaaatgatagttacagataaaaaacatatctcagatgctggaaggggaggttactgtgaactcaagcgatttgggaaggctttctgaggcagcacagggttgcagctcaaggctgaaggcaatctaacaggatacagtggggggccaagtgcggtggctcatgcctgtaatcccagcactttcaaactccaaggcag

SEQ ID NO: 391816 - DNA, 445 bp, Homo sapiens
tcgaagctcttattatttgcactgtggcagattcacttgagttcagaagcctagggaaaaggtgggacttttgaaactagggcagtaggtaaatgtggacacaccttcgtttgtatttgattagggatctgacagcgtgcatatgtgtacaggtttgcacgtgtgcatacacacatatacaaatcatagaaaaccataggtgttctgtgagagagaaaattttgctacttaaatacagcgtgaattctcatcctgatagttgcagaaaatatttcttttaaaatggagattaatgtctaattccatataaagaagattataggaaaggtgatttaaactgtaagtagctttgttcaccaaaacgctagatttatttgaaacagtgttttatttcttttggaaggcagacaactagtttaatagtgtacatatgaaacgctaattt

SEQ ID NO: 391817 - DNA, 576 bp, Homo sapiens
tgtttatctgacttcaaagcccatacttaaataattgcttctgtgtaatgttttttctctcctcttaaaccaaagttttagaaatagtcagcattagaatttcaagtactttatattccagcttgttaactgaaaatgagatatttaatttatatgcacagtaatgcatataacaccagtgctttataaaaaatgtggaagactgttacaagtatggacaaaattacacatttaactttaaaaaggtagcatttattcttttcttactgaaagcaaatattaaaaggcagaagttcatctctcatcgatcatattgtttttattaagaattaataacaagtgatatttgaatcttttaaaacaaacctatttaatttagctcagatgaagaaatttattggtgtcctaaaagccacctggaagataacctttttgtggtgttggatggtattcatcatatttatctcttgaaactcttagcttttgtgatggtattgcaccaccttgcttctcctttgacttttcttgccgtctgtatcatttgctaagcaaattctcagtcatgacttgtgatca

SEQ ID NO: 391818 - DNA, 330 bp, Homo sapiens
ctgaaaccctcctatgcactgagtgcttcattataacatctctaattcttacatctacaatgccagttacctattcctgtcctcggtttatggagaaggaaacagatatgcttaataacacacaaatctacaaatgtgttatcctcatattatggatgaggaggctgagccacagggaggcaaaataagttttccaagaacaatcactgcaaagctctggaggtgggatctgagtccagcactaccttgctgcattctccttgatactcccattgcatgtgttgcctcgcacaggatgctgtagggataggtgattctgtattttctagg

SEQ ID NO: 391819 - DNA, 408 bp, Homo sapiens
ttggattcagacggatctgagttctaatcctgactctgctctattcaagttatttgacctctatgtaactatttctttacctgaaaagtagagaatataactcctagcaagtagtgggtactcaagataagatggttttctggccaggtgtggtggctcatgcctgtaatcctagcactttgggaggctgaggtgggtggatcacctgaggtcaagagttcaagaccggcctggccaacatggtgaaaccccatctctattaaaaatacaaaattagccaggtgtggtggcaggcacctgtaatgtcagctactcgggaggctgaggcaggagaattgcttgaacctgggaggtggagattgcagtgagccaagctcatcatgccattgcactccagtctgggtgaca

SEQ ID NO: 391820 - DNA, 580 bp, Homo sapiens
ggagttgggcaatcatgtggagcttggacacctcaggaagtcaggacatggttggtgactgtatcccatcaccgttacttagctttatggttttctgaaagcaggttgctgcctgctgggatcaccttgacaactaagagcttctcttgcaggtgaaacttgcctaagtacttggtaaggtctgcagggaaattgagggctccaggaaggtggtaaggtgcgagaacaccttcactgcctctcctccctctccccttttttttttttgagacagagtctcgctctgtcacccaagctggagtggcagtgtgatctcggctcactgcaacctccacctcccaggttcaagcgattctcctgcctcagcctcccaagtagctgggattacaggcgtgagccaccaggcccggactaattttttttggtgtagacggggtttctccatgttggccaggctggtttcaaactcctgactcaagtgatctgcctgcctcggcctcccaaaatgataggattacaggcgtgagccaccacaccctgctctctcctctctctctgggactaaatcatccatgagtat

SEQ ID NO: 391821 - DNA, 508 bp, Homo sapiens
ctgactcagcctcctgagtagctggagttacaggcgcctgcaaccatgcccgctaatttattttatttttttagtagagacggggtttcactgtgttagccaggatgatctcaatctcctgaccttgcgatccgcccgccttggactctcgaagtgttgggattacaggcgtgagccactgcacctggcctttttttttgcagagtctcactatgtagcccaggctggagtgcagtggtgtgatctcactgcatcctctgcctcctgggttcaagcgattctcctgcctcagcctcttcagtagcttggattacaggcacccgccaccaagcccggctaatttttttatatttttagcagagatggggtttcaccatgctggccagactggtcttgaactcctaacttcaagtgatccaccgcacccagcgtgaggcatggtcttgaatatgcatgtctcacatttccaggtgatactgctgctgctggtctgaggactacagttgga

SEQ ID NO: 391822 - DNA, 336 bp, Homo sapiens
cggcccctggagctgcggccgggcgtgggtcagtcgttcacgggcccggaaattccactgggacacccgaaaaagtgctgcacgccgcctgagggagacggaaagggacccggggcactgagtccattgctggggtcgccagggtacgtggcaggacccgctgtgcacactcgggactgaggagacccctgggacgcggagagccgctccagggcagaaccagtccgtcagcatttagccttccacgggcctgagggtgcgagccctgcgggggccacagggtcattgtccaaagtcatccccgtttgcactgtggcagcaccgaacccggaagta

SEQ ID NO: 391823 - DNA, 109 bp, Homo sapiens
ttctttagctgaataagttatgtggtcctgcttttactattttaaccatttgacttcacagctttaaatgccatcttcatctatcttcttacatgcttttggtaagttt

SEQ ID NO: 391824 - DNA, 426 bp, Homo sapiens
tgtgtatgaggatttctgctttgttttttccttagcagagctgatctctatcaggatgcaggagttattttgagcagtttaagggacatctggaggaggcacaaagagtggagcctctgaagagggaatctgggagtcgaggaccaagtcctcggtgaatctgggcactggctgggagttccaggaccctctggaggaagaaaaggggatttggattcagcagcagcagcagaggaagacccagaagaacatgccggggtctgacaaggtaaaagaaaagactcaactgagtggccctggtgctcgcagacttggggtaggcagttcacgtgtgctcatgtggcttcattgccctgcgctgtgtctgatcactgataaatcataggtccagacccgtggcagctgtgtcagtatatggtcagcctg

SEQ ID NO: 391825 - DNA, 134 bp, Homo sapiens
gccagataccaggcttaaacagtattctctgatccttaagtctatattcctgagtggatgaaactgttaattatccaccattgtccccgtctttcttctagtaatagaagctcccaagttttaggtagacacat

SEQ ID NO: 391826 - DNA, 697 bp, Homo sapiens
acatttacaggaatgtttattgcaacattgtttaaaacaagagaaaaaaacagaaacaaagtaaatgttcaccaacaggagactggataaacaaagtataatgtataatggaatatgttgtagcagttaaaataaagaaagaaaagctacatatatcattatagtctacgtagtatcaacttggataaacctcaaaagtcattagtagtgagcaaaaaaagcaggttgcagaaggatacatacaatatgataccagttatatacaatgtttatggttcaacttttccagtctggtttattgagctacaatttgcatacagtgaaattgactagtctttgtgtacagttttgtgagtctggcagaatgcatacctttaggtagacatcatcacaatcaagatataaaagggttccatcattccccaaaattgcacactgccctattgtagtcaagtcttacccccacctcacatctcctgtaatcatggagcacatagcattttgagtctgtcttcttccacttagcataatgcctttgagattcattcatgttgttgagtatctcaacggctttttttttaactgctgaatagtagtctactgtatggatgtaccaatttatccattctgtagttgaagtgcatttgacttgtttgtactttggggcaattataaataaactgaccataaatatttg

SEQ ID NO: 391827 - DNA, 215 bp, Homo sapiens
gaagggtgaacactaacatctggagctagagacagcctcttgggagtcatttctgtacaagtggtcattgagatgacatggagtggataaaactgtgtgaagagttgagaaaaagaggaataaaaccctagggagcatttaagagtggagagagaaggctgtggaggaggcagagagagagtagggtcagcaggtcagaagagatcccagaggcg

SEQ ID NO: 391828 - DNA, 411 bp, Homo sapiens
gggagggggctcacaggcattctcttccagtatgtatgagtccttgatccagtagagccttgaaagaatgtggaactacaatgagtagtcagggattctgatgccctgggagtgggttacctggactcagccagagtgctgcagatgggctgctggcctagcctccttgctggcctagcctccttcccggcctagcctccttcccttccccaaggctggcctggaatcattctggcctcggggtagaggggaagtggcagccatcagggcatttccctcctgatcccactgtccactggctgtttggggtcactgtcctcagcattctagtagcgccccctctgaactccagctgcttcttcacaactcactttatccaccattcgcattacgtatttttggcacccattt

SEQ ID NO: 391829 - DNA, 130 bp, Homo sapiens
ccgcagggcttgtaaaaatgaactgtgattactactctggaaaggtctctcatctgactggggagaagggccacacacacaaacaagagcagcaaagcatgtagtgcctgcggaaagagctgctgatgga

SEQ ID NO: 391830 - DNA, 369 bp, Homo sapiens
agcaagttgctcaataaatagctcatcaccctaaaaataacgaggtctctgatgagacttagtctctaatgaaactaagcacaggactgagggggtgaagagcaagcagaaaatggatttccaccatgggctagactgttcacgtggcccagtggtggagagaatccttagggaaagcctaactccgaagcccagagaaggaaggaaaactaataaggagtgtgttttgcaggctgatttttctgaagttatccataggaaaattcatttatgtgagaggctaattagtcatgacagtgctttgctccagacataattgcattggtcccatgcagtctctgtgggtcagcctgtaatggaatttccatt

SEQ ID NO: 391831 - DNA, 293 bp, Homo sapiens
acagatgggttcagttataaggttatgcttcaacaaaaaagtgcagacatggcagcttgtaactgaccattgccacagaaattaaaattggggagataccatggagcaaacgttcttaatcctctttataataaccaagtcttaaggtttattatttgtagcctgatgcccattaaactattgagcaactttggaaatctatgtggagcaacagcttgtattttgcttgcactaacttgctagaaaatgcatatttaataagcttaatgatctctctagagaggcatattttg

SEQ ID NO: 391832 - DNA, 3621 bp, Homo sapiens
  misc_feature (915)..(915): n is a, c, g, or t
  misc_feature (1258)..(1258): n is a, c, g, or t
tagggaattttggccctcgaggcccaagaattcggcacagcggtaggagaatcacttgaacctgggaagtggagattgaggtgagccgagattgcaccattgccactccagcctgagcaacaagagcgaaactcgcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaaggnaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactnagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttaaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagga

SEQ ID NO: 391833 - DNA, 244 bp, Homo sapiens
tagggaattttggccctcgaggcccaagaattcggcacagcggtaggagaatcacttgaacctgggaagtggagattgaggtgagccgagattgcaccattgccactccagcctgagcaacaagagcgaaactcgcactccgccacccacatgccaactgacttgatgcttaataaaactgctgctgcctgtttgattctatttaatgtataatttgaatattaaaccttttaacagaactgtc

SEQ ID NO: 391834 - DNA, 6580 bp, Homo sapiens
  misc_feature (3874)..(3874): n is a, c, g, or t
  misc_feature (4217)..(4217): n is a, c, g, or t
caagtcaaggttgcagagtgtatgcagccaggggtagcagccacttcaggatctgggtctggatttgtgctgagaaccactatgaccttttaaagccagtgaggaggttttctgggggcccagaagccctgagcccattggccagacctcctgggagaagcggagcggatttgcatcaaaaagaacactggcttcattgaaattctcctcatcttgagagaaacaaaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaaggnaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactnagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttaaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagga

SEQ ID NO: 391835 - DNA, 5971 bp, Homo sapiens
  misc_feature (3265)..(3265): n is a, c, g, or t
  misc_feature (3608)..(3608): n is a, c, g, or t
agatttcttcttcaagaaagctgggaagaagagaggccagagatagagagacagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaaggnaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactnagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttaaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagga

SEQ ID NO: 391836 - DNA, 1529 bp, Homo sapiens
tggtcatccttgttttgttcctgatctcaggggagaagcattcactaacttatcattaagtatgtttggctgagcacagtggcctacacctgcaatcccagtactttgggaggctgaggcaggaggattgcttgagctcaggaattcgagaccagcctgggcaacatagaactgggactggcagaagggggccatggatgagatgtctgagcaggctgagtcgtggatgacaagccgaggagagggaaacttgggtgagcatttgtcgtcggggtgctgccaccagcccccaagcaggtgtgagttgctttggagggcctgccactgcttcttggctcccagaaagggggcatctccagctgtgctgaggcttccgggttgtggttgaggcttgggttgtggttcagctggggcacctggactacattctgtgccgggggcctggccttgcctccccagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtc

SEQ ID NO: 391837 - DNA, 1324 bp, Homo sapiens
tggtcatccttgttttgttcctgatctcaggggagaagcattcactaacttatcattaagtatgtttggctgagcacagtggcctacacctgcaatcccagtactttgggaggctgaggcaggaggattgcttgagctcaggaattcgagaccagcctgggcaacatagaactgggactggcagaagggggccatggatgagatgtctgagcaggctgagtcgtggatgacaagccgaggagagggaaacttggaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtc

SEQ ID NO: 391838 - DNA, 4484 bp, Homo sapiens
  misc_feature (1778)..(1778): n is a, c, g, or t
  misc_feature (2121)..(2121): n is a, c, g, or t
cttttctattttttaattgcttcaacaatttattcattcaagagatggaacaaataaatccatttcagagaaaatggactgagggtcaaaactgggtacaggtcaaggaaaaggcagatgtagcttacactactttcctatgtgtataaaagaaactgatcttttataacctattctcagaggtgacataccaacccttcatctatactccactggccacaaccagtggtataacacaggagactacacacaagccatatgaataccaggagcgatcactgtcttggaggctggctactgacggtcctgattatctggcttaattcctgagttatatataggactgagtgtgagtctttaccacacacattctcagagttctcagagcctgggcctcactcatttcttctcatttcccttttaggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaaggnaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactnagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttaaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagga

SEQ ID NO: 391839 - DNA, 2837 bp, Homo sapiens
caagtcaaggttgcagagtgtatgcagccaggggtagcagccacttcaggatctgggtctggatttgtgctgagaaccactatgaccttttaaagccagtgaggaggttttctgggggcccagaagccctgagcccattggccagacctcctgggagaagcggagcggatttgcatcaaaaagaacactggcttcattgaaattctcctcatcttgagagaaacaaaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaagcatggtcaaaaagtcccatgtggcgcagcatcatcacggcactgagcaggagggctgtgggattcgccatgtccttgcctgcaatgtctggagccgtcccatgaacctacacatcgggaacaagtagcatcatcaagggagagacaaaaactaacagtcctcttctggggaagctggagtcttaaccatctttcctcagcaatacaaaatatgcactgaaagctactgcgtgcaattcatctgatatggactgaagaaataaagtctgg

SEQ ID NO: 391840 - DNA, 3203 bp, Homo sapiens
caagtcaaggttgcagagtgtatgcagccaggggtagcagccacttcaggatctgggtctggatttgtgctgagaaccactatgaccttttaaagccagtgaggaggttttctgggggcccagaagccctgagcccattggccagacctcctgggagaagcggagcggatttgcatcaaaaagaacactggcttcattgaaattctcctcatcttgagagaaacaaaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtc

SEQ ID NO: 391841 - DNA, 6329 bp, Homo sapiens
  misc_feature (3623)..(3623): n is a, c, g, or t
  misc_feature (3966)..(3966): n is a, c, g, or t
gtgcctgccaggtgcaagaaggaggaagggcggtccggtggagccgggcctctctggggctgctgtggctctcccggggggactccgtgacatgttctctgaggttctggctctctcctgggcaagctcacagattgcagccaccccccaggcaccatgccagaggtgctcctgctcaggtctgccagctccatcctgaggactgcgttcttaagcagatggctgccaggtgggcctaggtgtgttcacaaacttagttttgttcggaacctgcagtgccgacaaggagtgaggctgaatgtgagaagcagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtcaacaaggacctgattttttttgtcaattgagcaggtgggaccagtgcagagagtagtgggcatttaactcacaggactgtgcacagcgggcatgcgagtgaccattagtgccctggaataaacaaaggtgcaggatggggtcaagtggcgcattctcataaaagcagccagctctacgttagcctgtcgccaccagaccaccccacttccattctgaatacgggaagcagccattctcagtagcaagctgagccaaaatgaccgaaggcatctgaacaggaaacaggtagagaaagcaaacatctcagttttggaattctttattactttgaacccaagagccactgataactggcacaatccaatgaaacagaggaagcagcagcttaaacaaaggaaaatacatttaagattataagtctgggggggcggttacaagcttaaaaagtgacccagacagggatatcattgctaaaaaaaaaaaaatccccttgtgacctgggtacattttgcaaagccacaggtttgcaatgttacacaagggccaaaggaggccatgagttgtctttggttgtggggacagagggtaactgttcatgaaaatagtgagtgtctgaagattaagaaaatcatgctgcagcagaggagaagggagaggaagacaggaaggnaaaggagatgcctgagggtcaaaagctgagcccaagcctaagcccaagctcaagctcaagccccagcatggcataattttgtgaattaactcaggctgagttgcctccagtctttggaatgtcatcttatactggtactgctgaggcagagggcagtaattggtgctttgggataggagaaggggcagttgctgaaatacaaaattaatagcatcccaagttcctcaattgcagccaaaatacatgtgttcgggcctttcggcagtatcgcccccagaactacctgctgtagtgtggtccattcccagacagcaacatgcaagaataagtttacaatacactnagcccttctggcttcagatcaggggctcagaggctgtgacaactcatgatgctgaaaatgtatccagtgaaaatgaagtactagctctctgcttcattaaaagctcttggaaagaatattaaatctcaagacaacaaaataattgaacacacaatacatttgtgtctttgtatccaatatattacctttgtcttattaacaaaaattatatctctcattatatatttcttggatctgaagtttttattcacactcagtaatttctgtaaaggacaaatctgtctctattttccatatcatttagaaatataccacattcactctttttgatgtgaactttcccaggaaaattctcttgtgcccatttagttttagaagagtgtcattttgtgctattatgtcaatatcctgttttatttccattatgtttttcaaaaaccgaagaaaataaggtttttcttaaaaagttagacattttctcttgttaattctgtatcctgttatttacagctgaagagaaactattttaacttaagtgtaaaatggtttagaatagcaaatgatacagtccactcagagtttacaaaaaaaacatttaccaggtagacacttaataaataaaacaagcacttggaaaaagttctttgaaaacagacctagggacatccacctgcatcttttgcacagattttgttaagaaaaggccagatctaaaaatgtactgtcaagaaacaagcaaaccaatgcatacatacgtaggtattctaaacagaggttcatgtggtgtccatttagagtgactgatgtaaatgccagttgtagaagtgttaatctaaatcttttactcggcgacagatttcctctgtgaagtctgagcattttgcattgcctcccaaatcttttgtcaagctctgagaaaaggaaaaagcaaaaataaaagatgtatccgcaaactaaactaaaccaaggagattttaaagccctcagtgagatgccacctgggcaagttactcggctgctctttcatttagttcctcatttcaaagtgaggaaccactccaccaccatctacccagcccaggaggatcgggatccaatctcatagtgtatacaacagcactctgcaaagaataaggtgctcttgatgcaaagggaggcagggagctttaccaaaattttccctttgttcacacaatagaccctaacccagattagttggtcatggatatttaaataaaagcgaatctaaataagaagtttaaaaatccttgggaaatatgtctcaggaatagacctgagacatattttgatctatttttgtttttattattattttttttttagatggagtctcactctgttgcccaggctggagtgcagtggcacgatcccagctcaccacaacctctgcctcctgggttcaagcgattctcctgcctcagcgtcctgaatagctggaattacaagtgcatgccaccatacccaactaatttttgtatctgatctatttttggaggctgggacacaaatacgaaagaaatatttaaatcattaactcttttttttttttttaagagacggggtctcactatgtggcccaggctggtcttgaactcagaggctaaggtgatcctcctgcctcagcctatagctgcaactacaggcatgcaccaccacacctgcctaaatcattaactcttaaacctccctctttaggaaagaaagcctcccatacaactgatctgttctaccagcttatcctttctttcctgcatacagaccccaatatatttaattctctttatctttccatcctacacaataaaagggcccactatgtaattcaggcacctctctactgggctgtagattataacttcccaaatataactttaaagaataagaaaatcatatgacctccaatgtgactatcaggctgttaaaaacaagcctgaatttcttgtattttggccacacgatataatttcaaattacagaatttttttaaaagaagggaccaactttgaagatattacgctaagtgaaataagccagactcaaaggacaaatactgtatgattccacttacatgaggtacctagagtagtcaaattcatagagacaggaagcagaatggcaggtgtcagaggatgggagggggaagggaaagttactgtttaacgggtgcagagtctcagtttgagaaaatgaaactggtctggagatgactgatggtgatggttacattacaatgtgaatgtacttaacattattgaactgtatacctaaatacggctaaaatggcaaattttatgttatgcatatttttcacaatttttgttaaaaaggacctcaaattagga

SEQ ID NO: 391842 - DNA, 2210 bp, Homo sapiens
cagagacctttactaagccgactcacacagggagatggggtactttttagaaggtgacatttctcttactgaaacctgatctatttttcctgtcaatgcagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaatcagggcctatgcctgcagtttctatagaatagagggcaggcgttccgagcctcttcctgagccccaggtctcttcagtctgggcacaggcatttctgccaagtctgttagatctccaggtcagggcacagcactggctctacatttaccaggtcttacgccaacaatagctgacaattccaagaagcttcacgtgtgggtagttttaattcagtttaagtattgctttttgttcaggtgacaaatgagatcagctctccttccagaacgaaagggctgataatttttggccttagttccaggtagattaaaaagctgctagctcacatacaggacagccagcagtaggctgtggagcgggtaggagagagatggctgatactgctcacgtgcgctgcaggaaaagcaatcagtcacaactcacctagcgacctgacttactctggaatcttggcgggcatcgccgaccctattattccattaccaggcactccgccacccacatgccaactgacttgatgcttaataaaactgctgctgcctgtttgattctatttaatgtataatttgaatattaaaccttttaacagaactgtc

SEQ ID NO: 391843 - DNA, 2864 bp, Homo sapiens
caagtcaaggttgcagagtgtatgcagccaggggtagcagccacttcaggatctgggtctggatttgtgctgagaaccactatgaccttttaaagccagtgaggaggttttctgggggcccagaagccctgagcccattggccagacctcctgggagaagcggagcggatttgcatcaaaaagaacactggcttcattgaaattctcctcatcttgagagaaacaaaaccacaaagaaaaggaaagttttaattctgagaaacttcactgaggagcaattttttttgagcttctaaaaatagagaggaaatgagcctctttgggtcactctagttgccgcctcccctgccccatgcccacccccactgctcactcaaggctagcctctctcagtgggtgactgagctgtcttcagtggaagcccgaggcagatgccacgcaattctggagctggatacggctgcccacacggggaccccagcatgctggacagcagagagaccccacaggagagccggcaggacatgattgtgaggaccacccaagaaaaattgaaaaccagctcactgactgacaggcagccactctccaaagagtccctgaaccatgctctcgagctctcagtgccagagaaggtgaataatgcccagtgggatgctccagaggaggcgctgtggacgactcgggccgatgggcgggtgcgcctgcgcatagaccccagctgcccacagcttccctacactgtgcatcggatgttctacgaggccctggataagtatggggacctcatcgctttgggcttcaagcgccaggacaagtgggaacacatctcctactcccaatactacctgctcgcccgcagagccgccaagggcttcctgaagctcggcctgaagcaggcccacagtgtggccatcctcggcttcaactccccggagtggttcttctcggcagtgggcacagtatttgcaggtggcatcgtcactggcatctacaccaccagctccccagaggcctgccagtacatcgcttatgactgctgcgccaatgtcatcatggtcgacacgcagaagcagctggaaaagatcctgaagatctggaaacagttgccacatctaaaggcagtcgtgatatataaagaacctcctccaaacaagatggccaatgtgtacacgatggaggaattcatggagctggggaatgaagtgcctgaggaagccctggacgccatcattgacacccagcagcccaaccagtgctgtgtgctagtctacacttccggcaccactgggaaccccaagggcgtgatgctgagtcaagacaatatcacgtggacggcacggtacggcagccaggccggtgacatccggccggcagaagtccagcaggaggtggtagtcagctacctgcccctcagccatattgccgcccagatctacgacctgtggacaggcatccagtggggggcccaggtttgctttgccgaacccgacgccctgaaggggagcctggtgaacacgctgcgggaggtggagcccacatcacacatgggggtgccccgggtatgggagaagatcatggagcgcatccaggaggtggcggctcagtctggcttcatccggcgaaagatgctgctgtgggccatgtcggtgaccttggagcagaacctcacctgccccggcagcgacctgaagcccttcacaaccagactggcagattacctggtgctagccaaggttcgccaggcactgggatttgccaagtgtcaaaagaacttctatggagcggcccccatgatggcagagacacagcacttcttcctgggtctcaacatccgcttgtatgcgggctacggcctcagtgagacctcaggcccccacttcatgtccagtccctacaactaccggctgtacagctcaggcaagttggtgcccggctgtcgggtgaagctggtgaaccaggacgcagagggcattggcgagatctgcctgtggggccgcaccatattcatgggctacctgaacatggaggacaagacttgtgaggccatcgacgaggaaggctggctgcacacgggtgatgctggccgcctggacgccgatggcttcctctacatcactgggcgcctcaaagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaagcaaaacacgcagcctcaattcttgcagcatggtcaaaaagtcccatgtggcgcagcatcatcacggcactgagcaggagggctgtgggattcgccatgtccttgcctgcaatgtctggagccgtcccatgaacctacacatcgggaacaagtagcatcatcaagggagagacaaaaactaacagtcctcttctggggaagctggagtcttaaccatctttcctcagcaatacaaaatatgcactgaaagctactgcgtgcaattcatctgatatggactgaagaaataaagtctgg

SEQ ID NO: 391844 - DNA, 588 bp, Homo sapiens
aaaactgaccttaaaagtctaggggttcggctggaagaaggtttttggttttgttcatgttgttttgctttatttggttaatggaagattataggctaaatctcagttcttttctttgtgttgactctttaggtttccaagtctactttgttttgttttattttttctccaagttacttctttgcacatttccctgagaattagctaccatccaactagaattccaaaatagtagtttctgagcaggacgttgaatatttggtaccctcaaactctttggggcaacaagatagggcctatgatccttcatgttttctgatccagaagctggaagggaaccatctgtccaggagacacccatccaacagtgggggacagtgaccagctgtctgggatggtcaagtacatgcagcctgttggctcagttctcacttgctctgttttctctgggtcacgctgctgcatcttatgctgtagttgacagtactgccttttctctaaggttgtgaactgatgcctaatttccatggtcttcagattagctgagtttgagaaatatttagtatgtaattcatgatgatgtgcaag

SEQ ID NO: 391845 - DNA, 836 bp, Homo sapiens
  misc_feature (1)..(1): n is a, c, g, or t
  misc_feature (18)..(18): n is a, c, g, or t
  misc_feature (20)..(20): n is a, c, g, or t
nggagcatccagcgcggntnctgcagacaggggcgaaggagccgctgagagtgaggcaagagcgggaagccgaaggaaggaaaggagatggggaagggaagaaaaggaaggaaggaagaaaggaagataatgtgttccatcagtattctggtagaaagaatttcaaaccatgcttctctggttaaatatattgattagcattaaaatttgttttgaaagtatctggtgattttgcatttaccagcatctctattctctagttttagcaagtgtttcctttttcacctacagaccctggtagttcagccaggtggatagttgcccataagtctgttgtttggggctctgtctgtatcccatgtgaccagcttctaaccattttgaactttagtttcccttttctgctatgtcaaatattttgattttccataatcatcctgagtccctatccaacaacctttacaactgatacagcctcactttctgttagataacttagtgttaattaaagcagtctcactaaaacgtgcttttgctgttcttccccattttcaccaaagtgaatgagccagtccactaaaaatcagggcctatgggatacacagtgtcctgggtcacaaggcattactgtctttaatgatttgctgggaacaaacgaatcagccatattttctccatcagccatataagaaatctcagaaatacctggatcccttctgcctcacttcgctatggaaccatttttgtttaaatggtcttttaaattggagttgtaagcatcagttgtcttttattcactacctaataaaggatgaagcctaaccacagaacttaca

SEQ ID NO: 391846 - DNA, 525 bp, Homo sapiens
gctcgacgaaaatggaatccttttaacaggcttcaatgttctctgaacaaagtaggagatcatttttatattgtatcagaactgaatcacaaggtcacaagggaaatttatgtcttttgtttcgttttgttttgttttgagacagtttcgctctgtcgcccaggctggagtgcagtggcacaatctcggttcactgcaacctctgcctcccgggttcaagcagttctcttgcctcagcctcccaagtaactggtactacaggtatgtgtcaccacacccggctaatttttggtatttttagaagagacggggtttcactgtgttagccaggatgctcttgatctgctgaccttgtgatccacccatcttggcctcccaaagtgctgggattacaggcatgagccactgtgcccggcctcaaactttttattctcttggctctggcagcgtagtactcacctgtgtaagacagaataataatacaaccaaagatgtgtataccctaatctcctatgaagatattac

SEQ ID NO: 391847 - DNA, 462 bp, Homo sapiens
ctacagacaactggacaggagagagagaaaacagccctctggattctccaggatggcagccgatgtcactagaagctcagggctgatgttcctggttggctattgcaccatttcagctgatacagtccaccatcactgattaccggcgcggttgcggtggatgcacttgaaccaaaccagtgtatctcctgtgatttgttttcatgtgtccgaagacaccagggaaacagagatcctggtgttgttccttgttattacgttttactgctgaaagtaagaggtttatttttctgtcactcagtggagacataccctggaaaggagaggggaaaaaaaaagcaaagatacaagagataatcacctttgcatttgaaagttgaggcccgaggtttactacaaccagcatttttgccaacggttggtgattgatttccatcacggtgtgtggggtgggaagaagtt

SEQ ID NO: 391848 - DNA, 414 bp, Homo sapiens
gcagcctgcttactcaaaccctagtctgactcccctctggagcttgctggattgtgaggaaagtggtgtgtgtacagacagccattggcctgaatcccatcttttccactggagagcttttcacttttgccttaatgacaagcaaatggttccttatgggaattttgcctaactttaggggtgagcgctctagaggaggggggagggttagaagcttcaatgcctaccagaccaagcaagtaacaaatatgtggagtgagtgagccaggtataaaacaaaaaggctaggatgagacctgtggcaaaccagagaataaatatcccctctaaaggcagcggctgtcccagctgagctgtcttgcaggagcactgtcttagcatagctaggtctttaagagaagccagaaatctcgt

SEQ ID NO: 391849 - DNA, 130 bp, Homo sapiens
gctcagaaacagctacgcagtgtttccagtgaatcttggaatgagccaccctaaatacacagccagccccaaacccaaatggttgccacacaggtgccagagttggaccacaggatttgaatccaggccc

SEQ ID NO: 391850 - DNA, 116 bp, Homo sapiens
ttcagaggaatttctaggactgctaaccttctattggcttactagggattcaggtcctaatctataacctcaacatgtgctttgaccatgtgcctcccaggctccactacggatat

SEQ ID NO: 391851 - DNA, 375 bp, Homo sapiens
ataattgtatacccatgttcatagcaacattattgacaatagacaacaggtaggagccacctaagagaacaggtaagcaaaatgtggtacatacatagaactgattcagccttaaaaaggaaggaaaatctgatacatgctacaacacagatgaacttgaggacattatactacgtgaaataagccagtcacaacaggacaaataccaatgactccattatatgaggcatgaagaatagtcaaattcattgaaacagaaagttggatggtggtggctaggcactttggggaaggaggaatcggggggtgtttaatggatttggagtctcagttttatgagatgaaacagggtgggcaggtgtggtagcgcacacc

SEQ ID NO: 391852 - DNA, 367 bp, Homo sapiens
tgctgctgtgcaaaagtgtgagttgtcggtttgtttcattgtacagttgcatcatgctggggtcgtcgtaactggactggctgctttccccgacgtcatcctccatggagatattcttaccatctgtgtgctctgtcttgagttcattttcatccaggttgtgagtggtatttatttcagaactgttatctgtatgaggtgaagcccacatgtctaggttcccaggacctgaactgattcgatttcgagatgactgttgcagtgactgttgcagtgactgaggaggaatgtcagtctcctctgccatggagttaccatcttttgactcaaaaccttcctctttagcaaatggcttgtgttcagtttc

SEQ ID NO: 391853 - DNA, 353 bp, Homo sapiens
actccccaatgagctcaaatgcttaggagaagaaggagacatctccccctgtgaagaagtggactctggggatgagtgattcaccaaaacaagtcaccagaacattaaggtccatgataaacacttcagacaagtccatttatcatcttcaacccagagacaaaagttgccaagtagactgcttaagtacccccttcagagataaagatgagaactgcaaccatttgtctccatccagctgtcctctgcaggtgccttctaccactcaacaagtatttaataaggatgtgctttcttcattcaatacttgaacccctaactctcaacacatgacctaaaaatactgcaccatg

SEQ ID NO: 391854 - DNA, 430 bp, Homo sapiens
gcctcccaaagtcctgggattacaggtgtgagctactgcacccagccgcaaatatatattgataacttactggaagtaaggtaacatggtacaggttggtagaagaaatatagagaaaaacaggaagctgggcttcccttccagatgtccctagattcaaaggggaagaggcaaaatgtattaaatgtgacccttgagcaaggctgcccgtgagaaacttcccaacttcatgggcaatgttgaaaacatttgtccacttgcccttgccccagagagggagaaggtccacatatggtgcctttgacatgttatcccttggcataaagtttggcccaaatgtacatttgaaacctcacgttccctcgataaatttaaagtatgaaacttttgaaactctaaaaaggtggtgaagaccacagttctccctgtt

SEQ ID NO: 391855 - DNA, 414 bp, Homo sapiens
agcagggcctcgaaggttggcaagggacttgcagggacagagcatggagatgggcatatgtagcgtgtgttctggacacggcacgtggaggcagagcacacatgcatagagtgtgtaatgcttcacttccatccttgttccttcagcaagcacccgtgctttacctcgtgctgacccttgagcaaggctgcccgtgagaaacttcccaacttcatgggcaatgttgaaaacatttgtccacttgcccttgccccagagagggagaaggtccacatatggtgcctttgacatgttatcccttggcataaagtttggcccaaatgtacatttgaaacctcacgttccctcgataaatttaaagtatgaaacttttgaaactctaaaaaggtggtgaagaccacagttctccctgtt

SEQ ID NO: 391856 - DNA, 228 bp, Homo sapiens
gccgttctgccccccagccccagccgggccacagccagcgaggccacatggaggcctgacctgttggatgacgggccactggcctccccagaccgcacggtccaagggttgcgtccaactccacatctggacttttcgaattggtcgtggcttccaactggaacaaaaggacccgggatggggaaaacatgggttccccctgccccaccccacctgtttgcacaaagg

SEQ ID NO: 391857 - DNA, 636 bp, Homo sapiens
gtgttggttagtggcttagtgtgcggtaggctacccatgaaacctttgtgctccgatgcctgactgaggacacagtcctcctaaaaaagagtgtgaggcccatcccagcatggctgactctctaatggccaagttcttttgggcctgtgtgtggcttagctctcaggacggtcaggtaatatgtccagagctgggccttgggacctggctagacagacctgaagagttttctgttgcaatcaaataaaggataacaatattaatttggaacatgttgagaagacattgttgtaattaagcacaagttaagcatacataataagcacttcacataattgattagaattattttaacacaaccaaagcaagatccaaaaattcaaaacaaaaattcaattctcagtctttctctctttctcatgctagtgaccattattgacactgtcacctgatttcacctagaatttatttctcaatttacttgatattctctaagtcatagcacttaatatgatgacttctgtacagcaacagtttccttacgcctgatttcctagggccaaggactcaaggagtctgtaaaatttgaccataatttaaaattggtcatatgttcgatgagtaggagagttgatg

SEQ ID NO: 391858 - DNA, 638 bp, Homo sapiens
tcttgaggaccccggcgcatggggtctgtaggctacccatgaaacctttgtgctccgatgcctgactgaggacacagtcctcctaaaaaagagtgtgaggcccatcccagcatggctgactctctaatggccaagttcttttgggcctgtgtgtggcttagctctcaggacggtcaggtaatatgtccagagctgggccttgggacctggctagacagacctgaagagttttctgttgcaatcaaataaaggataacaatattaatttggaacatgttgagaagacattgttgtaattaagcacaagttaagcatacataataagcacttcacataattgattagaattattttaacacaaccaaagcaagatccaaaaattcaaaacaaaaattcaattctcagtctttctctctttctcatgctagtgaccattattgacactgtcacctgatttcacctagaatttatttctcaatttacttgatattctctaagtcatagcacttaatatgatgacttctgtacagcaacagtttccttacgcctgatttcctagggccaaggactcaaggagtctgtaaaatttgaccataatttaaaattggtcatatgttcgatgagtaggagagttgatg

SEQ ID NO: 391859 - DNA, 569 bp, Homo sapiens
ccaagatcgtgccactgcactccagcctgggagacagagtgagactctgcctcaagaaaaaaaaaaaaaaaattccagtctgagcttaaaaggcaaagtgttttgttaaattctctgactgagaacctgcctaagcacgacactccataggttcaaactcagccacctttgaacaaggagaaccaatggaggtcatcctgataagcagcaaattagagcctcattcatcattgctcagatgagattcaaatgcctgtctcaagacaccacatggagagtgagaactatgggattcaacaggagcagacagcacatatcacttcacattccatgataaataaataccaagtagacttgagcattcccccgaacgtgtacagaatgaaggttccgaagatttaagataaaatcttgactacttgattagcataatctccatggtcagaaatgatttcttattcataatggtgctctatgtccctgtaaaacttaccttttaatatccaagttgacgtgtcttgcaatgatgttaaaaagattatggaaatatgatatgcaataggctcttt

SEQ ID NO: 391860 - DNA, 223 bp, Homo sapiens
tcctgcacttacctgcaggctcacctgcaggccacaccagctttccttggcttcctcaaggaaagcccctcactgcctacctcagagacagctccggtgccgtgccctgtgccaggaatgctgttcctaacctcttccccaagcccccgtgcatcttccaggtttcagcttaaatgctactttcccaaggaagccttttcctgaccctctcctcaaacaagtc

SEQ ID NO: 391861 - DNA, 352 bp, Homo sapiens
tccttcagcttaatctctcccactctaagttcccaagctgcccctaatcccgctcaaagcagccctgagaaacatcgccaattatctctccataccaccccaaaaaattttcaccgtcccaacactttaccactatttcgttttatttctcttattaatataagaagacaatagcaactaataaaaacttaaaagaactcaaagaaattttaaaatacttgtgatattgtgacttattataagaaatataaatctggtctttatccccatttcctggcttacagctccgaaagcccttgcattctctgaagttataagtgtctttttgtatgctaataagatgactgatggc

SEQ ID NO: 391862 - DNA, 302 bp, Homo sapiens
cccagctggttctttgcctccctgcactcctacccgattcgggtcttacatcctgcccccttcagcccccagccaggtgatcagtctccatgaagcccaaatctgatcatgtgccaacctgcttccaagcctataatggcccccatgaccctacagtaagagccagactcccccaggaccctgcccgatcctgcccctgctgacccccagggcctggcccacagatctcagtggcacaaatctgccactagggaccccgcgtgcccagttctttcccatcccagagagcgggagcaggctga

SEQ ID NO: 391863 - DNA, 521 bp, Homo sapiens
tctctcagtttctgtgggtcaggaagccaggtacagcttacctgaatcctgtttcagggtcttgcccaggctacagggaaggtgccagctagagccatagtcctctcaactggggctggatccatttcctggctcagtcattgattgctggcaggattcagttcctcataggttgttggactgaaaccttcagtagtctctggctgatcactggaggctgccctcaattccttgctatgtgggcctctccatagagagcttcatcagaccaagtaagtgacagcaacagagagaatgccagaaggtggaagccaccgtctttttaaacgcaagtgtggaagcgacatctcattatttttgatgtattctgttcactagaaagaagtcactagatccagtccaccctcaaaaagagtggagtatataagagtgtgaatagcaggaggtggggactgttggcccaccacaagaaacacatgtaatatctattgagcactatgcctcatatttctcaatgccag

SEQ ID NO: 391864 - DNA, 313 bp, Homo sapiens
cctgactcttatatgcaaactgttcagccagcagatgtttgctttgtcccccattttgctccttcccctaatttcttctttaaagaaattaaattgcctgaggaagactaggatagctgggttttaaggtggcatctgagaacaaagcacattgcaggctgacatttagaaatctcaaggcataaagatcagtttacgtggaaacaaagcctgccattcatctcctcttatccatgtacacagagcttccaggaaagttttctactgcttcattcttaaatatgaatggacaaccataagccagaagctattt

SEQ ID NO: 391865 - DNA, 466 bp, Homo sapiens
gtgaaacgtaagatcctacatcatgagaacatataaaatgaaagggaactgaaaaaaagaaggagtcattggagatgatgggaaaaatggaagatacgagaaaaacaatgcttgtaatattttctcaaaattaacatctgtacctcaacattttccgcatttgctttaacccgtaggtatgattactctttgtttcaggtcgggggctgagacagaagaggtatattctccactagaaaacctttcctgattctactaaactccaacttggctagtgctttcttccccaactttctctctgtgtgtgcatgagagtgcatgaatgtacctgagcacatatacagacgtacacagcttcaatcctgtactgatgtctccactgtggaaaaatgtcaagaaggtccaagagtacaagaaggtccccaactagaaatcacagcataaggattcctattatcttattttc

SEQ ID NO: 391866 - DNA, 557 bp, Homo sapiens
gcatggtcctgtcggttgctaccgacagcctggttcaaaagttagggatttcagttaactttcctgctacttcaaagtaaggtgggctaagaaaagcaccaggccatgggccagtacactgcttttcagtgtcatgaacatcagcttgaatcctagctctgccacttagctgggagagctttgccgaactacttcacttttctaagtatcagttttctaatctgtgtaaggggatatgaatacttacatctagagctgtggaaaggataaatgagatttgtaaggtgctggtacattgccagtaatcaagaaatgaccaacaatgacattgatataattatgatgcacgttactaaggtatactaagatgctgggtccttaagggattttatctgtagagtcaacatagcctattatctaatgagtgatcttaggaaactcgtttgaatttgtttccccagttattacatagacagggagcccagtttttcagagaagccgtatgcaatgctctcttctaaggactcttgcactctcttcatgtaaaaaggcttatg

SEQ ID NO: 391867 - DNA, 463 bp, Homo sapiens
cagggtgagacagagcactctggggttgtccaacgacaacatggggcagcaggaacaaaaacatagcctacatcagtccacccaacctcgcttcccctcttcattcccaatccagggtgtagcctgggcaggttcaaagagctcattctgatctgtggtgaccccaggaaatctgccctaaaccctctaagcagagttttttggacaaccagtgtgtgatccaggagtggtagctaaattatagtggttggaaaggctaaggattgctaagacactctagagctaatctaaatttccagagggacccagcacagataccctctaactgtcaagatgaaagcaggtaccagggaaactcaactgccattgaggacacctaaacactacccatttcagtggccaaccattctgcatgctagtattttcatattttcaaagacaacttgtaaattcacttgacagt

SEQ ID NO: 391868 - DNA, 814 bp, Homo sapiens
accagtactgttgcttctccattcccgagttagtccatctcctgattgaatttcattgtcaggcagtcttttcaagttacaggtactgcatgcattctttgggttcttatacacttcattgattcaaaatatttgtcttttgtttttatattacttgaaggattacttggctaggtataaaatttatcagtcacactttattccccctcaactttgtaaatgttgttccataatctcctagtgtttgattggctggatttctttgtccaatgttttctctttttattaggaagaatttgtgagtattatagtctctgagtttcaatgcttgctgttttctttaatgcttgagaatgtctgtctattgctttcgttcctgaaaaataacttgtttgggaacactttcattagaactttgtggtccctgttttattattttgggacatctagtgttactgtagaaaagtctgatttttctccctacctccttgaaggcaatttttttttttaatctaaaatgcctgagagttttcttctttatttttgaaattcagtaatataaacaaggtatatctaagtgtcacttataatcatttttccctaaattatagtatgcccttagttcttctaagaacattttccttgtttattaccatgaatacttttttttggtcaaattattagatcctctacttcatgacaccagtttttttaatactgaattttcttttgttgttcgtatgtattctaattgctttgatttgtcttttacctttgcatttactgtgatcatctgaagcctttctttttgtca

SEQ ID NO: 391869 - DNA, 320 bp, Homo sapiens
tccctctgtgtgcatgtctgtgtcctaatctcctcttcctataaggacatcagtcattggattagggtctaccctaggggcctcattttaacttaattacctgtctaaagaccctatctccaaatgcagtcacatgctgaattactggtggttagaacctaagaatttggggttaatacgattcagccataaaaccaagcattcaaataatacacaatactatcctagagcaatatttcaaactgtccctttctttggcactctaggagtttgtacgctccagaataaagcattatagtaagattgaccaacaaaaaaaa

SEQ ID NO: 391870 - DNA, 363 bp, Homo sapiens
cttttgggtcactttgtttgtatttctcacaccaggcctcctctgcttcaaggaggcagagtgggacgattcagaactaaacggccactgtttgtacccacaccggaaggcagcatggtagaagcatttccctaaaatcaggaacaggacaaggatggcctgtcacacttccatacagccctgctcaggagggcctggcccaggcagcaaaacaggaaggaaaaatacgaaagatataaggaagaaacagagtcttcaccactcccacatgacgtgaatgtctactgagaaaatccccaaaatctacaaataaattttaagcaatggcaaggtgatcagctgttaaatcaatacccaaaagtc

SEQ ID NO: 391871 - DNA, 453 bp, Homo sapiens
ttgtctgatctgttacttttcttcttgaaatccactaatggtaccctattggcctatgggaaaaattccagccaccctcaagttagttcccagtgctcttcagtgccctgtgagatcctggatggaacgagatagacctgccctctcctgaccttggcaactccacagcccttgccctgaaccaggtgctgtattagataaggaggcagcaggcatcacacatgtgtaaccttgtttcattttaggattgaccagccacttggaaagttttagggactatctctcaataagagataaaactcttactggcatacctctctgtctctcttctttaccagtaatcacaattttggataagcttttgcattttggcaaccatgaaggatggtaagtaaagaggtctaatatcgtaagtcttgagcagggcaggtagcagctacggttgccatgatg

SEQ ID NO: 391872 - DNA, 314 bp, Homo sapiens
agtaaatcaccagacatttgaagaaagcctctaacatgaagaaaaaatattcctgaagttgagttctatgcccagacaagtgcaagggacatttacaaggtctccaaatatttagctgccatgaaccctttctcaggaagctactagaggatgtgctccaacaaaacaaagaattaaccaagaaaaagatacaagctctaggaaacagggaatctaacacaggagagaaggaaaaatggagtaatccctgctaagatcccacattcccaaacctaaattaagttgttatctgaccttcctagaaatcagaagaa

SEQ ID NO: 391873 - DNA, 799 bp, Homo sapiens
atttgctcttggaattctccctctcaggaaactaacagcctgctatgaagcccaagccacaaagagaggccaaggggaaataaacagagtgtgattatatgcaaaacctacaagaatgaggacctccaaactcagtgtacagagtgattttctgctgaaacaattggcttttaaaaaattgtgtgactgaccagcagcagtggctcacatctgtaatcccagcactttgggaggccgagaaaataaaagagacatcagtgtgtgaatgacgactttctgttgctgacttggaagacagaggaattgggtcatgagccaaggaaggtgggcagcttctaaaaggcggaaaagaactgaattgaattcaaatcaaaaaaggtctgaacctcatttaaaagatggttttgtaactgaagaattgaaaggatttctttatgaactagcatcatcttaagacaaaggataaggaccctgaagacagcattatagtgaatcccagaggtgctctccaaaatggtgctaatacagccaagaatacaggtatgaggaaggatgtggaagggtaccttacaggagaaagcaccacttatccaccaagatggcagaggccttcttttctgacccgtggtacaaaaagaaaacattatacaggagagacaataggcaaacaaagagcacacgagaagaaacatagaatgaaagacaagagagggtcaaagagaagaaaaataagatcacatgaaggtgataatacaattttatatagaacacggcaatttgcaatccacaagctgatcta

SEQ ID NO: 391874 - DNA, 674 bp, Homo sapiens
aacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagat

SEQ ID NO: 391875 - DNA, 393 bp, Homo sapiens
ggtgagtgatggatacattggtaatatgggtgaatgatgtttctatatgtaatagtaatctttgttgaaactagctctttccaaaaatggcatttatctctcagtttcaacgggatgttcttcttgactaggcatgttccaaaggagaaatgattgcaatcacaaccagttaggatctctgtcctgtcttaaaaacactcagcatgagcaaggccttcagatgaaagccatgaaaagattaagaggtagattccattgaaatctacccaggaagtgaaagcctgccaggttaaagataatttcacatctcatttctcctaaaacaaaccacctaataacaggctcattgatcttcaagtctggagaatacattacagctgtcagtttcccctt

SEQ ID NO: 391876 - DNA, 641 bp, Homo sapiens
gacttcatagttaccagaacacaataaaaggaactgctgggcaacactcaagcatggaagaaagaatgagaaaggaaccagaatcacttccctctctttaaggtgaatggttccagacactcatgattgcaaaataaatattaaaatcccttcataaaagtcagttgtgcacctggactcagggttaccatggagattcaaggcagcaatctcactgacactggatccgtgccttctctcaccccaaagttacctatgaggaattcctgagttttactgtggttcatttaacatccggagttcagagacatgaatacttgagcaggccggggcttcgtgagaactaaagcaatgttagaagagcccgcatgactgccttaatgaggaagactctgctggaactggggtcagggtctccaggaaattccagtccatcatctcccttggtgagcaaaagaagccactggtggtccttgcaagtagaagtgcaatgaaaacaggattatggcgatggatgacagtgtgagagagaaaagaattatcaccttcttcccctttcccaaataattcattctctaagttcagcagtccaacaagaatggcttctcatgccagagtagactcttcttgtatttaggacg

SEQ ID NO: 391877 - DNA, 659 bp, Homo sapiens
  misc_feature (220)..(220): n is a, c, g, or t
gttttgtagtatacgtctttaattcgtcacgaccctacttcaggtgacattttaccactttacaacagttcatttttattttccccctcctggtctttgtgctattcttgtcatacattttacgtccatgtaagtttgttgttgttgttgtttgaaacagagtcttactgtgttgcccagactggagtgcagtggcgtgatctcagctcactgcaacctnccacctcccgaattcaagtgattctcctgcctcagactcccaagtagctgggattacaggcacccgccaccacgcctggctaatttttgtatttttagtagagacaacttttcaccatgttgaccaggctggtcttgaactcctgactcggcctcgcaaagtgctgggattacaggcatgagccaccgggcctgacctacttctataaaagttttaaactgcagtatgttgttgttatttttgctttaaacaatcagttctcttttgtggatacttaaataaacaattctttatatttatcgatgttgtttccatttctgatattgttcattcttttgtgtatatccagattctaatctggtgttgttttcctattccttgaaggactttctttaccatttctttaaaatgtaaggactgtggtgaattcttttacctt

SEQ ID NO: 391878 - DNA, 504 bp, Homo sapiens
caaacagttttccaaagtgagatatgaacaagtcatattttctgaaaaaaatttgaagcttgtcatagttgaaatatttgagaatctcagtgggacttagtccaaggatatttgccacaaattaaaactacagaattcgggttgtaaaacttttagcatttccacatggctaataaagaatcactaagtactactgaaacacctataaatcctccccctcatgccccagtgggcccaaagttagccagttttataaaatttaattccttgtgtcaatgttttgtgaggcatttttattttttagatgcagcctctaagtgttgactctgtctaaacatctatcaagtataaaggatgatttgttgaacttaaaagaagagaagtcaccatggtaatgagaaacttgttggagcacatcattgttcttagcaactacaactcttatctgagacacctttctgagaaaaaaatcactcaattattccctttattaagaggtgctaa

SEQ ID NO: 391879 - DNA, 221 bp, Homo sapiens
ctgccattcccttttaaaacttaattgctgtttttagatcaaatagccacccaaagtagcaggcaagaacatgactacatacttctcttttccacctagaattaatttcactagtgccaattattttcaggaaagaaatgcatctccaaatggcacttgaaaaaagaaaaaaaactgggcaaaaatttcacacctccaggcaaatcctttacatcatttga

SEQ ID NO: 391880 - DNA, 2266 bp, Homo sapiens
gccccagccgggccggacgcgggagggtcagggccagggtgagcgcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaaccagatgaggctgtggctttttatattcaacagccaataaaaaatgcacaacatgctaagatcaaagcaaca

SEQ ID NO: 391881 - DNA, 2217 bp, Homo sapiens
gcacgaggaccattctgatgttggagcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaaccagatgaggctgtggctttttatattcaacagccaataaaaaatgcacaacatgctaagatcaaagcaaca

SEQ ID NO: 391882 - DNA, 2228 bp, Homo sapiens
gccccagccgggccggacgcgggagggtcagggccagggtgagcgcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcaaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaaccagatgaggctgtggctttttatattcaacagccaataaaaaatgcacaacatgctaagatcaaagcaaca

SEQ ID NO: 391883 - DNA, 363 bp, Homo sapiens
gtaacccacagtgtggagggttatttgtagaaactgactcaagacctaggctgtgatttccacactattgtttctttggccttttcccacagagactcaagctaactggcttatttcttcttttgaagatctctggcctttgacttctgtttttgccaatgaataacatgtgataatccatactttagatgggtagtttcagattcgcttagtctaatttactacctaaaagtaatataaaaagtaagtatgaaattatagctcttagaattggaggtaagggttggaaggttttatctagggaagacagtagctcatcaacaatcttagatgagtatagaattttgcgttcaagtcctatat

SEQ ID NO: 391884 - DNA, 293 bp, Homo sapiens
gtttttggcctgggaagcagtagagccattcattccctgagcagagggggaggttgggcgaggatgatgagtttaatttttaaatcctattttttcccacctgactttgtggtcaatcagaattaactctggggacaaatacctgtttacctctctagcttcaaaagattcaactaaactaaattaacaagacaggttcagtcttgctcctaaaaggcatgcctcagttgatccttaccagccttttccgggaacacagtagaatggattagtcattatcctctgcttctgat

SEQ ID NO: 391885 - DNA, 373 bp, Homo sapiens
aagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtg

SEQ ID NO: 391886 - DNA, 533 bp, Homo sapiens
acttgaaacttaggaaattttcaaagatttagagtggggccaaatcacaaactcaatgctgcagaacccaagcagaaaaggaaggggctcaggtcctttagagcagggaattccttggtcctacatacctcaaagcatgatctgaaatgggttatgggtatatcccagtggctctgcagactcctggctgtggagagtgtcacaatctgagagccagaatggctctaaagggagggcccagggatccaggcttactactcttgctgttgttaaaagctgatctggtcgctgtgattgttttcaggtgaaggtcacacgccctagctaaacaggcagttgctacacagctcaagccagttgttacaaggaataatgtgagcctggtattgcctggtcttttgattctttaagtgtaaaatatgtatttttatgtctataaaaatatgtaactggactacatagcagctaagatagatagctgtacctaatatatcaacacagatatatttcaaaaacaatggtgtttttgagaa

SEQ ID NO: 391887 - DNA, 470 bp, Homo sapiens
gagaggacgtatcagcatctacctctctggttacctagctactaatcacagtatggcaggcagctaggtgtgtagattctactgtgtcatcgaaccaatttttcaaacagaaagtcagtgagatgtgattaaagcccaagtgctgcaaaagatacaaggtggtctattggaactcctcaatcttcctggaaactgtcaccacataatcacagaaatatcaaatcatagcaaaacttaagctttccttttcttttttcgcctttttttttcttttcttttttttttttggcacactacttttaatagcagaacagtgtgaattaagataatgtgtaactgaagtctaagaatccctgagggtcatgcagatctctcaggtacagtgtgtctgaaacctaacttatccttcagtagagtcttggctacatttcaggtagtgaataaggatataagggtgacagttgggtgaa

SEQ ID NO: 391888 - DNA, 319 bp, Homo sapiens
acttccttacatatcagaaagggagaggagtcaccgccacaaaatcctagcccagcgaccccacaggaaagagctgctttgtcccatcatcatctaaaatcctgtggaagttgtttattgacccaggtcaagccgtgtaaccaggaagagcaagatcttatgattgggaactacatgatgaagcggaggggaagttcattaaaggaaggatgtggatctctttccaaagaactggggagggctacggggcagaaaaagaggttcactgcctagggtatggcggtctaaaggactgaggaaggaccaagtctaacgagaa

SEQ ID NO: 391889 - DNA, 326 bp, Homo sapiens
tggggaagcctcattaaaggcactaatgagcgctccctttcatcgcaggcactgtcttgacatctccatagatgtctctgcaatgatgggcccctccctgtgtactgcctgggagagcagccagggcgaacctgcaatgggggctgagctctgtgaacaaaagaagcctcccttctgaaaggcaagcccaagttgaagtcatcagacagagataactgagctacgggccctcaaggctacactggagcaggtctgaggccagcccagactcttgtcattagaacagtctgcaagacatatggctggcattttgctgaccaagcccc

SEQ ID NO: 391890 - DNA, 304 bp, Homo sapiens
cagggggaaccgaaggctctaggaaagccaaggctggggcaggcgcggcggccggcagtggagggaggacagagcgccgcacaattctcccacctcactccctggctgagcccctgctggagagattctgggaacagccgtggggcctcagaggcctgtggtacaaggcctgagttggaactccgagaacctaagcttccttccccttcttcagtccacccaacactgagaccacaaagaaatggccccaggcggtctaagaacacgggggccgaacctgaggtgcttcaaccttgaagcggag

SEQ ID NO: 391891 - DNA, 162 bp, Homo sapiens
catgatttccagacacttcactactcttaggatacttgttttggatgcattcttttctatctgtgacctaaaattgccttagtttttatagctaccttgttgttcttttggtttttgttaaacttatttgcactgaagctttatttctcatatgaactgctg

SEQ ID NO: 391892 - DNA, 820 bp, Homo sapiens
acggttctatgaattttaacacacatatagatctgggtaacaatcatcaaaatcaaaacatatattagttccatcaccccctgaaaatattcccctgtgctatcgatcctacctttacagtaatctcaaccccagtcaaccactggtttcccatcattatatctttgtcttccagaatgtgacaaaaatgggattttacagtatgtaaccttttgggactgcctccttgcactcaacagaatgcctctgagattcacccacattgctgcatgcatcaataattcatctctttaatagtcccttgtatgactatatcacaagttatccattcacctgctgagggacatttgggttgtttctagaagtttttaataattatgaatagaactgctataaatattcatgttatgcttttatataaacatagccttcatttctctaagacactcagaagtggtattgctgggtcatatgttaggtgtatgtttaactttatagaaaactgctaaaatgctttccagatcggctgtactattttgcattcccactagcaatataagcaatatatgagagttccagttgctccacatccttgccaacgcttggtattgtcaatatttttaattttagacattagactagatcgtagtggcatcccaccacatatggttttaatttacatttccctcagggttaacgatgtttcaatacctttcattgcttatttgccatcatcatatccttttttactgaattgtctgttcaatcctttgtccatttaaaaaaatcatgttgcttgtttctttttgttgacttttga

SEQ ID NO: 391893 - DNA, 100 bp, Homo sapiens
tcccacccactccttggactgctgcaggcaccaggagatgacagatgtcagtctttggagtttggctgatggagggaatgccggtatattcctgagaagc

SEQ ID NO: 391894 - DNA, 410 bp, Homo sapiens
gcgaggttgtaattatgactagttggtaccttcctggcccagaatcatggctaaaaagttaaagttttctgctcattgagagggagtggggaatagaagggaatatgaaggccgaaatcagattgactgcatgttcttactggataacatgaaaggttaatttgttaggaaaacagtaagttttgacctccctctcctgtgggcaggggcacctcttgcacaggtgggtctgtgtcttcatacatgtaggggagagaacgctttgtaggtggccaaagaggggcaaggaagcagggctgaacgcctgaatgtgaaaaggttgccctggagtctggcgcgggaaaggatcaggggtgtgagtgcagggagtctcacttacttcctcttgatgccgtttcggagctatttga

SEQ ID NO: 391895 - DNA, 874 bp, Homo sapiens
tgtattcagtgtgactgcccagcagtcacgggctctaggcctggtcagacctgctcccttcctcagtcgaggggagagaggtgcatccatccccagcggggcacccgctgcagctccggtaccccagccagctccaggccgggtgcccattgcagcttcggtaccccagccagctccagcacggcaggtgccctgtctccgtggcccggtaggtctcctctcagcgagtctcctgttcatgagctgtgcctgttttttggtgttttgctttcctacagctacgaggaacttcttcagtctgtggatgccaatccttttccaattttattcactgtaactactatttggccagttcacagcttttattttccattggtttatggtgactttaacaatgttgccttgtttcaatttgccaatgtttttctctatgcttttagttattaagaaatccttttctatctcaggcattaagaaaatctcctagtttttaactttaagattacactttttacatttagtcactccttcttttgggtttttatgaactatggaatatcaaatatgtataacataaaatttgccattttagctgtctttgagttacccgtcagtggcattcacgatgttgtgcaaccatcaccgtttctatttccaaagctccttatcacctgaacagactcattcactttctaacccgatattcagtggcactggctgagcatctcctaatggccgggccttgccctcagggggattgctgtctagcaggggaggcagacagacaggcacagtgggcacagcaaacaagtgaatgagagggcctggggctgggcaagggcagcctggatggctttgcagagggaacctttgt

SEQ ID NO: 391896 - DNA, 693 bp, Homo sapiens
tgtattcagtgtgactgcccagcagtcacgggctctaggcctggtcagacctgctcccttcctcagtcgaggggagagaggtgcatccatccccagcggggcacccgctgcagctccggtaccccagccagctccaggccgggtgcccattgcagcttcggtaccccagccagctccagcacggcaggtgccctgtctccgtggcccgctaccaaagaagagacaacatccagcagcagccactcccgccggactccagggaacaaggatggaatgagaattgagaagcagagctgagctgtgactcaagcaccgggctggctgccacacagcatccctgtgacactcagatgccagctaacgtgttctaataaaactaaccagtcacatcggtcaaaccctaccttgatccggtgatgggcccctgcccaccccaaaatttcccgcgtgttcatgaaagacgactaactccagaacggaacatgacgcacgtgccgagacatcagcattgagtaagcacccgctgtgggccaggcccggtctccggacagctgcgcgccctccagactccacggtcctacagacaatgaatattatgcaaccaaaatgtcctgggaattcagagccaaaggcagcattcttaggaaatgcctcccactctcctgccatggcatagagctctgctgggctctg

SEQ ID NO: 391897 - DNA, 308 bp, Homo sapiens
gggattacaggggtgagcaaccgcacccagccacaaagcctgtttaaacacattccaattttcacccaaatgtacaccttaatcctatcaactgttacatttctatattctcccagtctagttgtagcccatgttacagcttcactaatggattttggtacctccgtgtatgaggcttccatataaaggggtcccagaaagttctcttttcctcccattttacccagaaacttctcttcaccacccatttcatgtgcacaaagctttgggtccccatcccggggtggagccaaagaacctttgccctt

SEQ ID NO: 391898 - DNA, 474 bp, Homo sapiens
tctcttgggtatatactcgggagtggaatggctgggtgtcatatggtcactctatgttgagccttgaggaactgccagactcttttccgaagtggctgctccattctgcgtgccatcagcagtgtttgagggttctaattattccacattctagccaacacttggtaggattgccagtctggtcatttcatgccaagtgttcttgagaggcagtgtgtgtgcgtatgtgtctttgtgtgtgcatgtgtacactgtgtgtaaatggagtgtgttctgtagcatgagagatgtgcgtgggtaaatgtcctaatgatggcagaatgcccaaacatgaagatgtagtagaaccgtcagtggtagagcaatatagcacagactctctatggctaattgtgcaaggttcctctcacgagcaggaagagtgagacaggaagattaaaaagataatatatttttatgttggaattacttcgt

SEQ ID NO: 391899 - DNA, 278 bp, Homo sapiens
ctaaggaagtcgagatttcatagctgtattcggtgctgatattggtagtccgcatatacttgaagtttcccaaacagaacagacagaaaagaagccctctctggtttgtagaattgaattaacctcgacaagcagcatctctgaaaatatgtctgagttatgtctgctctatcagaactcaccatatactcacaagttaacaaatgctgagctgccattaattacatgggaatttaaacaactgcattttgctctgttttgacacagccactgctagg

SEQ ID NO: 391900 - DNA, 600 bp, Homo sapiens
tggtcaggttggtctcaaactcccgacctcaggtgatccgcccatctcgacctcccaaagtgctgggattacaggcatgagccgccgtgcccggctcaaaatgtatcttaataaagttcatatgtagttagagcagaggttaattgtatccctggtggtgttattagccagaactctctgaaatgtaaataattatacaatgctgttactacctttcatgttttgataccatagtaagtgactcacaaaaaatcagtgcttactattcatctgcatatgttttctgaatatcagtaacactttaaaaagaataatttttgtgagggttattccttagttgagtaactttgagcttaagtttttaagtgaacaaatcctcttacctctggcagtttagctatagaaaataaataacattaaatatacgttaactgtctcatatggttcatgactactattgaacaaaaattagacgtgtgatactgttattcacttattctcacatggtatattaactcttttgatcttagcatatccaaacaaaacacttgaccgactttaaaaagctggagcgggtaatactgaatagaaataagaaaa

SEQ ID NO: 391901 - DNA, 398 bp, Homo sapiens
caagatttgcttaggtatggaaatatcaattttcaaatagtcttacagtaaaacaaatttaaaaggtcctagaaggaaaaaaaaagttttagttaaactcacttatttgcaaactactaaaaaaataaaataaaatgcaaaactgtacttcacctttattttattgctggatgaaattttttgttttcagaattattttcagacaatactgtaaatttttatggccagaatcttagcatttgcattttttatgccagatatgcattattttgatgtctaggttccttcatcttaaaaatacagttcatgccaagttttgggagattgatcattaagcaagctggcgattaagcatagcaacactgaatgtatggatgtaaccattcagataggtggtt

SEQ ID NO: 391902 - DNA, 401 bp, Homo sapiens
tggaggtgctgtgggcaggggctggcttgggcaatgagaaaatggtgttgcttatgtgcccactctgtgctgggactcagctgtgagtgcctccaaattcaccacatttatcaaacctcagtgctctgagacagcatatgatggcctagcaggatgtccattcttttcctggaaccacccatccagttatctccttgagtcgcctgggtggtgaaaagtggtctcatgcacaatggatgcggtgtgatccccttgctatgtcacgcatggcgtctgccctcttccctggcacctgtgccactccaggttatgcctgtgctgctgcccattctacgcccacctggaaagcctgaaaccttctcgtgccttctactgcagctggggagcttcttccacgtctc

SEQ ID NO: 391903 - DNA, 708 bp, Homo sapiens
tgtgataaacaaagttccttttggtggcaccagcttacctctgacctaaaggggcacattcttccgtgccccaccatgcgtctcccaactcaatcatcagactcagttattctgaccaacgttataatatacagtatgaatcctcaactgttacaaaaatgtatttccacattgatcaaaatgtattgaaaaaaactattgcactgtttttgtatattgtttcagattccaatggaaagaactagaataaactataaattcttctaggacaaaaagaaaaaaaactctctgtcatcttctgccaccagaactctacaattcttagcacaagagagacattcaaaaactatctttagtaagataatttagtaagagtctggtaatagagaagtttaatggagagaagaggttggaaagtctattgcttgaggtggtggagactgtggtagtactgccctatggtgttgggaaccatagtttctgtgttttctgtcaaaagaactaaaaaattaagaggcgtgaggtggtttccatgaccatgtggaaagatcaaacatggaagaatatagaaaatcaactttcttttccttataatttaatttatgaacaattttcttttataaatttaagagaagcttaaatggggctctttctaacatagctttgaatgaggttccaataattaacatcagataacaagatgtgtat

SEQ ID NO: 391904 - DNA, 550 bp, Homo sapiens
ccaggcgcttgtgaaaagatacactgacatttaggcaggaaatgcacacaaggtaattcattcctattgaagctcactgagcatcaatctggttgcgatatgaattattcatgtccccccccaccccgccgccgctgccacgccagcctcatgttcaaggctgatgtcagtgcaggacccatagctcctctctctaggccctttcccgggcagctgtgcacagatcaacaccccgtcctagagccagctctcattctctctgtggtgagggctcacctacacggacccagaggctgcgatcgacacctgatgggccactacaattcaattttcttgtccatctgctagaagacagatgaattcatccaacagccagcccaggactccagaggaaacaacttgagataatttatgaattgatttatgccacttctctttccacaaagaatgtatggtggctgcataatatgccttttgttgaacttaccaaatcgttctctcatttcatgttgtggacgtcctagtagggagtgataaatgcatatgctat

SEQ ID NO: 391905 - DNA, 146 bp, Homo sapiens
acctaatagacatctacagaactctccaccccaaatcgaccaggagcctttctaatagttctaatatttctttgtatcattatactgccacatatttaaccggttggcatgcaggttttctgctgcagggccacgacattgtgatt

SEQ ID NO: 391906 - DNA, 483 bp, Homo sapiens
accaagtcatgtctggtaactaattagattaggaaagagatggaggaggagtgaggaaagtgttcagaatgactcgggtttctagcttttgcacaagatgaaggaggtggagccaactgagacagaatgcaggctgcacaggaagtttggggaagaagatgaggtggtccccacctcacagagggtcacccagtgtcactgagttgttagcaaaggtctgaaccagaaatgaaaaacagcatccctgactccacgttcttttacactactccatgctcccagccgctttttagagtttttccaagagttatttcatactgataaacaggattgtgaaggcaggtggaggggaaggacaggaagagttcagtaactgcagcttctgaagcaacacagaaaaactatctctagggctctggctgattgcaaataagctacatctgatgccctggggggactgggggcaacaaacatttactgagg

SEQ ID NO: 391907 - DNA, 442 bp, Homo sapiens
cccagcattcaaatggaatattgaagaactcgcagaaatgtcttttgaagcgctattgttcttttccatacacaaaggctctcttaaaggtttaggaagttcaaaatgcagtggtttgaaaggactgactttgtaactatttggcaacgctgggaggatccgcagggatgagaaaagaggccgaagtgggaagtgcaaatatgttgtgaccatcttcttgggaacggtgctgctatcaagtaggaattcttcaattctacacatcgagttggcaattaaatctcttcctaaagcagatttagaagatgatttttagtagtttttattttttaatggtttgcttgaggtctgaataggcatatctgaaacatttaatcatgttcattgtattcaacgataaaatctgaataaaaattacttattgttgatgaagctcatctca

SEQ ID NO: 391908 - DNA, 586 bp, Homo sapiens
ggaactagacatggttttggtgcctccctctggggatcagacaatttagagaggactttgttcctttaatgcacatgtagataaaagcgtccacacccatgcctatagccacgtgttgcacaagcgtaggggcgcacacacacgttccctctccaccttccgcacaaaaacagtatgtaatttaatcagcaaatgccccatttccatctctaccggaaagctttcagacgcattcccagatcagacagaggactagggttaaggctgggaatgaaacaccagctagtatcccagtgagctttcccaaacacacatacacagcaagtcagactaaacaacgtccaactgaagactcacctcaaatacttagacctaagattcacgtccaggctctttcagatacaccaggtaagtaagcacttggcattcctatctcagccattcacttcacagaatcttttgggtgcctactgtgtgcccaatactgtgcttagtggtacttgccctcagcaggaaaaaaaattaaaagtgttaaatgttatgaaagaaacagaatggaaatagaaaatcacaaggcattcaggtc

SEQ ID NO: 391909 - DNA, 701 bp, Homo sapiens
ccggatgcaaggtctcggatgcaaaggtctctggatgcaaagtgtcctctggatgcaaaagtgtctggttatattatatgtatttcacaaaatgcaagttagcctgagagtctagcatagattaagagatgcaatcaaacacacgctggtagtactggtgaagcagattaaacaggtaacccctgaaatgtgtacccaagaatatgtttagtttttagaaattgtcaacaaagtgaaaagctccaactatgcaaagaggacaagccctacctttgtaaacaagacacctttacaattgtgtatttgtgtatacaggttgaagatttggccagtagcatccgtgtcaaaataaaatagtgaaatgtccatatcttctcaatttcagcgataaaatccatcaatgcgtctccacattgattctttgctaatgacattggtttaaagattatcttgtttatttttcacatgatgactgaaatatctatgcatggtattacttttatatgtaaagttataccgtgttgacagattttgtagtcttttatatgacaaggcagtatgaaacaaaacctttccatgactaccaaagaaagcaatggggttaaatgacagagctttcctaactatttgtctgtcatagagaacagtaaattgcagcctgtctcaaggttggtgtttagacacattctcagattaacggt

SEQ ID NO: 391910 - DNA, 775 bp, Homo sapiens
ctcaaatgctccaggcatgtccaactgccaaactcctgaaatgaaacatcctctgaagtcacaaggcatagattgggccactgtagtcctcctgtgaccccaggaaaggcccctggcctcctcaagcctcagtttccatgtttgtcaagtggggagaataaagcagcactagcactgcctgcctcatggttctactgtaagaatcatggggcaggttgaaggcagagggacttcctcggctcagtgtgccttcaagtgggagctggggagtattagccatgttccagagcactgcaaatgcgctcctttaagagtagagacgctacctgtggacctcattttcactgtcatttttccatgtgttctgattttgtcctatttgccacaagagagggatggggttctcactgcgtcaactccacagagggctgttctccctgagtttttagcataagtaacccaggacccaaatgaggaatttgggtgtttagaggtcctcttatgggtttattttgaactagctgctaagaataatcattaatcatcatgaaataagtaaattgtgggatgccgcccatgcagcctgccatatggagttgccactgttagaagcaggatcttctcacagcaatatctgcccctggagaaggacatctgccatttgccttttttgtttgtttgttttattccctcctctctctctcttttatcttcatataccatcagtttctttcctaatcaataagcctcatggaccatctactattatctcagt

SEQ ID NO: 391911 - DNA, 317 bp, Homo sapiens
agtcagaggaattctaaaaagaatgtatggggaggggtaggcaggggaatcagctctgtcaaatattaaaatatataacaaaacatgtagttgttgcacaggcatgtatagaacagaatgagaaatccagaaacaaactcaaatacacctaagaattttgtatgtgatttttaaaatgttattaatattatttaaaatctgtaggtaaaagatgaatgttcaataaataggattaggattgctgggtaatcatctaggaaagtggatgaaagattaaaatataaaaaacaaaaagtgaccgggcatggtggctcaca

SEQ ID NO: 391912 - DNA, 638 bp, Homo sapiens
tgattaatgcaatatagtgtcaactagatgtagattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaaggaaacacctgctgacttgcagtttaaggggaatctattctccccatttccaaaccatgatatgaatgggcgctgacatgtggagagaatagataatttgtgtgtatgcaatgtgtgtattagataaataggattgggtatttaaattagcatttgtgaatttaatagcattaagattaccttcaaatgaaaaaaaatctcaaaatttctatttggttttggtgcattttcttttacaatgtaatcatatgatcttagtgtgttagacttgctgagtcctagctgtgtaaagaacatctctattctacatgcacattcctacatgcatcgg

SEQ ID NO: 391913 - DNA, 1501 bp, Homo sapiens
cgtcctcgtgctttctcttctctttagctgtttactcacgccaactaattagctgtcttgctttggtggatgtgctccgtcgctgtgttctttgtcgacagttagtctgatcgtttccttgttcttcttttgtttgttttctggtcttgtcgttttttgcttttcgttgtacttggtactccattgtccggcgttgtgtgtccttctcttcttccgtcgtacttgtttctgtgtctcgttttgtcttgtgttctgtgtcgactcttgtattggtgctattgtgtattgtctgggataattacgagagcaccgggcgggggagaaaaatatgtgttgtatgaataagataaatatcacctactagctagcaattgttttttcagcgcggcgcatcaaataatggttagctggtgggttttttccccaccaatcaatacgaccacctggctaggagtttggttattatttttctcgcctccaccgtagtggggtatataatatttttcgttcgtggtgggttgtgttttccggccccctatgttttgccccctgcccgccgcagggagtaggggctgcttctcgcagaaagggcgtcccggtggcgctgttgcccctcgcactcggtcttgtttttacaccctcgcgccgcgtgctcgtggtgtatttataataactagcgcactccctacctgtatgggggcgccccgcttgtatcacacaaagaccgctgggtgcggtcgttatgtatgggtggcgcccccgtcggaagaggagtatcttctatttggaccgcgcgccgccgcctgcctctgtttttctttttttttttttttttttttttttttttttttttttttttttttttttttttttttttttttttttttttttttttttttttttttgtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaaggaaacacctgctgacttgcagtttaaggggaatctattctccccatttccaaaccatgatatgaatgggcgctgacatgtggagagaatagataatttgtgtgtatgcaatgtgtgtattagataaataggattgggtatttaaattagcatttgtgaatttaatagcattaagattaccttcaaatgaaaaaaaatctcaaaatttctatttggttttggtgcattttcttttacaatgtaatcatatgatcttagtgtgttagacttgctgagtcctagctgtgtaaagaacatctctattctacatgcacattcctacatgcatcgg

SEQ ID NO: 391914 - DNA, 750 bp, Homo sapiens
  misc_feature (366)..(366): n is a, c, g, or t
aatctttaaaatgatgtaaagactggtttgctttagtatgaaggacccctagttgataaaccatatatttcctctaatagagaccccttcaagtataaaatttacttaaagaacaaaaaagcttccacttgatggatttttgtctcataatcagtgaatagtttcatcacatactgtccacagctgcgcctactgtccctgaaaaagatttcacacataggtctagcctttctcagtctggtatgtattcttgagaaagcatgtgtaagtattatttttgctaagtggaattatttttatttatttgtttatttttttgagacagagtctcactctgttgctaggctggagtgcagtggcgtgatncccggcttactgcaacttccgcctcctgggtttaagtgattctcctgcttcagcctccctagtagctgggactacaggtgcatgcgacaacatccagccaatttttgtacttttaatagagatgtggttttaccatgttggtcaggctggtctcgatccctttacctcatgatgtgcccaccttggcctcccaaagtgctgggattacaggcgcgagccactgtgcccggctggaatcatttttaatatagtttggctagtggtcagggctctgtttaatgaattttattttatttatttatttatttatttattttgagacaaagtcatgctctgttgcagtgagctgagatcacgtcactgcactccagactggcgacagag

SEQ ID NO: 391915 - DNA, 361 bp, Homo sapiens
agggtacacctaaaattcaacaaatgtcaaacatattgtgtaaaagaaaagaacacagctctgagcataacacatggaaagcagattttcccctgtaacattttccaggctaagccacttcaaacacctaaactggacatcagctgcaagacctataatgtgaagcatctgatttagataatgttatgatcaccataggtctatataacttaaacctaacaccagaaaagtaggaaattgttgacttgttgcaaactgtcatcaagtatattagactgtgcctatacagggaggttggggaaggatgccaagttaccctcaaccccaatccctaacttccttaattatcccagggagtgag

SEQ ID NO: 391916 - DNA, 787 bp, Homo sapiens
tcccagctggtgaataaaatctatcacgttgacaaaacagcgtgagtgaaaatcttttaaacatgcatcagctgcaggagctgagtgttgagaaatacaagattaagatgatgctggagagaactgaggggcactcacgttcacccctctaggaaaaccctgcctgtgctctactgagtcatacaccattagggtgataaggcaagctcagctgctaaagacatgtctttcctataatgtatatatcaaaaaaacatggcagagacgttatggctcagctccctgaatcaagttatctctaaaatgaagattagatattagttttattactctattattagagttataacaaatctaagtgctaaattcctttgaatatattgtccttcataccaagctggcaataccataaagataacaactgaggtagaatatttaacaaatatttattgatcacctactatgtgcgaaactacaaagataaatcagacttggtcttggacttgcaggagcaaaacttcatgttccgtgaggataataggcatacataaataacacccaagctgactataacatgaagaagaatggaggagtagaattctgtcatggtgtgtgtagggaggagggtgaggaagaatgaataaagatgacagttgggaaaagatagtttatataacattccagtgtggtctcggagttttcatcctgactggattactaacaagctgcgtgaccttcacccagtctctgtgctttcgttgtctcatctgtaaaatgaaggggttat

SEQ ID NO: 391917 - DNA, 341 bp, Homo sapiens
tccttatggggaggggtggcagtaggagtgaaaagaaaggaaaagagagacattttcaataagggagtacccaggcttgatgacaggttgaatgaccctgaagagataataaggctagaagctaacagcatagctgatattccctggtggcctgaggttccattttaagaactttgtatgcattaatacatttaaatttcacaataactctttaaggtaggtactgttttaattcccattttatagacagaacaactgaatcacagaaaagtttacacaattattcccaaaaggtggtagaacaaggatttggacctaaagaagctggctctggagcccca

SEQ ID NO: 391918 - DNA, 323 bp, Homo sapiens
ggtctgagaggctctgagccaggagcaactgagcgccggtgtctgggaggctgggaggcccgcttcacacctgaggggcagtgcttgctgtttagtgtcacggaagagcatccgggcacaagagacggaaaccacgggagtacgcagagtagcagagatttctccaaaaggccagcctgctctggatttgcctgaggggacttcgtcactgatgataagaaaacagctgccaggctattgcgttctttcattaaccctctgaccgctttttatttatttatttatttagaggcggagtttcgctcttgttgcccaggctggag

SEQ ID NO: 391919 - DNA, 155 bp, Homo sapiens
cactggctatctatcagttccaagagaactccacaaactcgaaatttaaaagatcaagttagaagatgataccccggaagcaatgaacacaactagcgatcatatcttattttcaaaactctgttctcccaacataaagtataagaattgcttag

SEQ ID NO: 391920 - DNA, 438 bp, Homo sapiens
agactctgtctcaaaaaaaaaaaaaaaaaaaaaaagaacctaacataggctgtgtttaactgtgataccaggtgaaatgagaaccacaatctcaggcataaagcccttctccttctccatcagattcaaggtaagagctcaggcccagttttgcatctaccttatttatgttcccatgtcaataaacagtaggtgtttcccttccttcactttccttttctagctattgaggggcaggttagagccacactctgacagtgatcatgtatcttagatttttgtggacaatcatgattttaaacatttttgtctggtggtccacctaagagcatgtcattttcatacaacaggctcccaaattaggtttagaaattatggccacagtgcctactgcacttaagatgcaacttggaggggtggggagggagtggcaggtga

SEQ ID NO: 391921 - DNA, 783 bp, Homo sapiens
aggccctcccacgctctgcccagatccctgggcaagagtccaccgtcagcatcgtcgcttagtgctctccctggttattccagaaacaccagtcgctgaggatctctcacctgcagttccctgctggatcttcattctgactggttgtacaggcatggcaacagcctctgttccacttctggggaggcctcagggaccttttattcatggcagaagacaaagtgggagcagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggcaagtgaaggagccagtgcccactatggccctgggagagccagaccccaaggcccagacaggctcaggtttccttccttcgcagcttttagaccaaaatatgaaagacttacaggcctcgctacaaggtaggtaaggtggggatcgaaactggggtacgtagtcattctgttgtttcaatccaaaagcatatgtcttccttcttggtcttgttcaatgtttgctctatttttattgaccttttgtacactggagactccggaatcacattccaactttatgtttcagggtgtaacatacattccttttcataattctcccctgtgttagcatcacaggttagatgagtggttctaaatcatattgtccatccttggatttagacttcttgtggcatactgagcaggatcc

SEQ ID NO: 391922 - DNA, 281 bp, Homo sapiens
ctttgactagactaggcttcagcttctgacaaagacagtaaaatgaaactggcttctgggaatggcataagagcctgtttatccaattcttcctttagattgttctcagttgagctcagcaaactaagtggacggaggcttgtaaaaggtaactgcaaaaagggtacaaggtgattttgcttaatttgcattttaaattatagcagtctatgcaaactgtttgaaggaagactgagagatgttttttggtggggaggcacaagattacagatagcttggaa

SEQ ID NO: 391923 - DNA, 409 bp, Homo sapiens
tccaaagtagaagtggcaagtcagcttctgggtcaaaatccttatgccaatgctctcagccgggctgcttttagatcctcaaggggagctttaaaaaacactagtgccaagtccccccttagcccaattagatagaatcccaggggggccaggactgagtacggggattctagaccagtgcttctcactccaacatgctaataaatcacttggtgatcctgttaaaatgcatatcctgcttctacaggtccgggttggggcctgagattctgcagttgggacaagctcacagatgctactgatgctgctggtccctggaactcacctaagtagcaggttcaggacctgcactgcccagcacggtagccactggccacaggtagcgatggagcactcaaaatgtggccag

SEQ ID NO: 391924 - DNA, 464 bp, Homo sapiens
ccacagaaatccatgagtataatccacagaaacaatccacagtctaatttctatacgggaaaagaactgggtaaattaagttagcaagagtccaaaagaaccagaggttatactgtaaccaggaagatccttccacagtacacatctggtatatatttaagtttggaagaccaaagttaattcccttcagtcaaatcctcctcttatttctgcttgaaatccaaggtgcatggtgataaatgtgcacaatttgcctaatttgcaatattagacatcccaatcccttcagataagccctccagaaattgagaaactgaaatggcttactatttttccctgaagaacttttgccttgggaatgtcattaccctaactttctatataatcttcgtctgggtaacttaaaacaagagatttaccttttttgctaaaagtggtatttgtatctgcctgaaatgatgaac

SEQ ID NO: 391925 - DNA, 573 bp, Homo sapiens
aacaataaaaaaattaaggtatttgtcatatctgttacagtattttttaatctttagtgattctttttggctcttagaatttttatctccttgcttacattgctcccctgttcttgcatgctctctacattattcattagagcccttagcaaattaataatagttgttttaaatttccattttgataattccaacgtccgttatatacctggatctggctttaagtcttattcttttcagactgtgtttattgccttttagtatgagacttgcaattttttcttgacagccagacaaaatgtactgggtaaaaggaatggctgtatttaagggtttattaatgtggtgtaaggtgctggagaaaaagtagcattcaacagttctatgataaggtctcaatcttttaccgagcctgtacctgtggattgtgaacttcgaacttccttctcagtttctgtctcctgcccttatgtagaatgagagggtttgagaggtctggagatgtatatttttctccatcccagaggaaggctagagaaagccggagtttagtttctgtagctttgcatttaa

SEQ ID NO: 391926 - DNA, 425 bp, Homo sapiens
ccaggtttctgtcttcccccaattgtttagtaaacttttttttccctctaattaaaaaacacactgagaaaactgcacaaatcataagtaaatattgcagtgatcttttacctgcaacacatcatctagatcaagaaatatagctttgccagcttcctgtaacccttgcctggtgtcccctcccagttgtcactcccatcaaaggcaggcattcttctgccttctattcctgacagttagtgtggcctgactttggaacgttgtataaatggaatcacattggatgaacttgattgtttctggtttctctggctcaccattttgaaattcacccatgtcatgtgtgcggttcacttattctcattgtggtatagtgtcccattgtatgactatgcaattcttaatccattctactgataatcttt

SEQ ID NO: 391927 - DNA, 415 bp, Homo sapiens
cagttcttataaaaattaccagaggacacagtataatttcagtgttgattatttatttaaaatattatacataatttagtttttgaggacagcagcgatcaacagacagtaatatctaggtaacaggaaagtaaattcattttattgttttaggtgctgtttagatagtgtcattgtttaggttctgtttctgtattgtttctgtgatagaaagtttcttggtgttttgaatcattaaccaaatgaactttcttattctcttattataggcttaaaatgaacttccagtggaaagtcactactactatcctaaaatttttatggtgggaaacagaattctaggatctcatgccagtagtgctattgacagtccatatgcttgtttgttgattaaactcaattttgaaacaattag

SEQ ID NO: 391928 - DNA, 546 bp, Homo sapiens
gtcctcactcacacccacaacctaactctcacctactcatgtccaatccagtccagctctggatttctttccccaagtgtcccgagtacctctgaccggactctgcaaacccctcaacactgcacaggtccaaagctgaactcatcttctcctgaaatgagctcctgcttctctgcattccctctctagtgactgggaacgttacctatccacccagctgcccaggcagtaaagcagagtcagcttcaactcctccctcgccgcagatccaatcagctttattgacacaacctaccagaatacacatctttagaatccttctatcttgagagcttgtttggaggttctagcaggggagcgcagctactcgtatacccttgaccaaagaccggtcctcctctatcggggatggtcgtcctcttcgaccgagcacgcagcttcgggagggacgcacatggaacggtgagggaggaaggggacacccgcctagccagccagatcagccgaatcaactctggcgatcaatggggtgacagatgtcacagc

SEQ ID NO: 391929 - DNA, 456 bp, Homo sapiens
gggattgaaggcatcaatggatgggtccaagagaaatgacaggagaagaactggaaacagtgcttttagataatccctttctagtcatctagtcattttgtcaacataggccagtagcttgagggggaatgtggcattaaagctgaaacatgaggtcatccaatctcgaaatagtcccaaatgattgctgaagactgacaagcaagtcagatgagacatggctcgaatgccaccagtaataatagaaatatttttagaagattcagatttcttctcttttttttttttggaccaaacatttttgtgatattctcacaatcttaatggaaaattataacaaacataaaaatcacacgggatctttcttttagaattctgcaaacacaacaacttttggttacactgatgattctggcagcacaggtagggctgttcctctgcagatgttactaaccc

SEQ ID NO: 391930 - DNA, 467 bp, Homo sapiens
gctctgattaaaactgacaaacatttaaactgagattaaaaataaattctacacattaatcatttacgcattcactttaaacttgcttacacttactgataatactgctttgtcttagtttatagatgtatattactcaaaatatttacagttcatttattgggaaccaggtaatgatggtattgaaaagaagttatgaacaattctcacttaataatacctacaatttattgagtgtttattatctgtcaggctctgctctatgttagtatctgtggacctctctctaagaaggtggtatttaatggtgccttgaaaagcaggtaggattttaataggcagcacacgaaaaagcacttaaggaagaaggagctacagaagctgaagcacggaaggctgggtaccaggtgctggatagttcaatatggctggagtttacacctgtccaggggaagaacaaaaggtga

SEQ ID NO: 391931 - DNA, 436 bp, Homo sapiens
ggaagcaattctgggtgtttaagaatgaagtaaaaatggtatttttatttcattttatgtgtacttttttttcaaatgactaataagttgttaggacataaatacttcagctgtttaaacccaactaattaaaaagaactgctgagtgtgttttttggctcaggggtactatgaaaacattactgagacaaattactgggaagcaagaaaggtggggaccccctggcctagcccaatgcctgctacacagcagaggtcttctgtgaagatgaccacaagtgattaaatccaggcaggtgctggaatgagcccagctgagaagttccacctgaatgaacccaacccaaagaattgtgagctaaatagatggttgttgttttaagccacatgctttgcagcagtttgttacagcgcagaagctaatggatacaagctt

SEQ ID NO: 391932 - DNA, 606 bp, Homo sapiens
agcggacgctctgccgccaggagtggcaggaggcgagctgagtgaaatgagctgctccagttcccgcccacgaagggggttaagatgaagggaacaatcctgtctcatctgggggcctgtccaggatatgaaaaacaagtatcactccatcacccaggctggagcacagtggtgcaacctcagctcactgcaagctctgcctcctgggttcgagtgattcatgtgcctcagcctcccaagtagctggaattacagactctacccaacaacagcagaatacacattttcttcaggttgaccaagagcattaaccaagagtaatcaaaaagaggagccgactagacacagccaggaagagcttctcccaccggaagaccagaccagcaagaaagttggcaccctccaagcaggttgttgaaaggaaggccttgaatgtggacagaggacgatgcagatgaggaaagactagaaggttctgtacctgttaacagtggctgatcctagaagagtgaaatttaggcaggtagttggaaagaacacagcacagaaaactttaggatgaattttcctagcagccattctgtatcgtcaaaggtgagttgcaga

SEQ ID NO: 391933 - DNA, 524 bp, Homo sapiens
tagtgcatagccagctccttgagcacaggaagggactctcttccacactggacacaggtggctccctcacttgtttccagaggtcctctttagagctagcacctgtctcccacaagcccccgcccccacccccccaaggaaattgaaggagaacagcacagaatgggatgcagctggggaaaacaatcttggcaatcctgcacagaccctatcagactgcagacagccatccacctattactgtgcctactacagatcctggccacagacctggatgcaaacctcaactccaaaaactagtctatggagttaaaagtcaggatagttcttactgtggggaggagggaagggaaggggttggggaggggcatgagaggggcttcagaatggtaagattctgtttcttgatctgggtggtagttactgggtgtgttctctttgtgatactctctcgagatgtacacttaggatttgcaatcttttctgtaaaatatttcaataaaagacatttattttttaaaaat

SEQ ID NO: 391934 - DNA, 239 bp, Homo sapiens
caagtgagattgtttcttcatcaggttgttcaggcttttgtcatccattggtatctaccctgccccagcctcctctccctgtgtttggctacagcagcctgaaggcccctcccaggcagaggtagaacaacagtggctcatggggcaggtgcagcctcgctgtgggctgctgttgacacccccaagcatgtcctcctgtgagtggcctgacccagggcagctgggcccagaagcatctg

SEQ ID NO: 391935 - DNA, 652 bp, Homo sapiens
agccgccgccaggggcgctcgtctccagggcgccggagcctgctcggggctggagcaggcaggcggagcccggctgaacggaggacgactgtccgagggaggaaagcccttcctccccccaccccaagccccagaagacagacttgcagacatctcctccagatacacagaccctcctccccaccaggagacagatgtacaaactccccgaaaggaacaggcaaactggggctcattccatccaccacgtgcaagaggggagtgagtgaccctgccagccgacagttgagccagactacattttaagcccatgctctttgctctccaccaaggttatacacaccccctcaacccagagagcaagaactgttcacaccagcccattgcaaactttcttctagggcagatggagtgtgggggaacagacctcaaaacatcatctcaatttctgctgtgttcccactgcccccaacttttctgctcctgttcccaaaagctgtatgcccaacagatctgggtgaagtccaagacacctcatccctgtgtgaccagggagccacgtgtatgagtctcaccatggagaaagaactgtggtctcctccaagcctctcttgagcaccaaagcccagcttcagcccaagagctaccagaa

SEQ ID NO: 391936 - DNA, 648 bp, Homo sapiens
ataaaaggtgtggtggtgggtgcctgtaatcccagttattcgggaggctgaggcaggagaatcacttgaacccgggaggcagaggttgcagtgagccgagatcacaccacttcactccagcctgggcaacagagtgagactccatctcaagaaaaaaaaagaaaaacatgctctaagcatttaaaatgtcattctctcttactttaaaacacacatatgaaagaatttaaactattaatgagctgacagggaaatgtggcagaaggatgaagattttatggtcatgaagccctaagtttggggtgctaggtaaccctactcaaagccccaatttctttgtttttattttaaattttatttttaactgacaaataatgattttatatatttgtgggatacagtttccttatttgtaatgcgggaattataataatatcttaccttttgtgaggattaaatgagagaatgtaataaagcacttaatacttagaaagcattaattcattcaacaaacatctgaggagttactaagtgaaggctcagtacaagtggtgaaaaaaacatgtagtgcctatcctcaggaaactctctttttagctggaaagatatttttaaaatgtataaaaacaaaaaaaatgtataattgtg

SEQ ID NO: 391937 - DNA, 518 bp, Homo sapiens
cgttaaaaccacaggcggcagagaacaagtggaggcggagagaagggaagaaaaccaaagctctggtaagaacgaagcccttgatatctgcaaaagtcgggagcatacggtttccatttattacttggacaaagagacactcccaccatcctgaattgagacattctcccactcagttccatgtggcaggaaccaaagcagcttcaatcttgaaggatgtctctgatcactctcagggcccactcataatccatattcatagtccagggtcacccaaggggatcagggcagagaaagcactgcaatgaaggaggagattcaagcccaccctgcttcctgctcccctgtgtggattccttatcctaaagaggctccagcattttaattccaccattagttcttgccctccctggccaacatcccagggtctggtccaagacagaggcagagcgtccatatctcaacctagttttagtgagaaggctatggaggcctctcaacatcaccctttctgtccc

SEQ ID NO: 391938 - DNA, 223 bp, Homo sapiens
tggatatatgtttaatatatccatacctatatatacgcaaaagtaattatttgatgttgagggtaaagttgctgaaaagtgtcaatggctctagaaatattttgtataaaaggatcaggactatacaacacatttaactgttgcaagtagattttatgtccgcagaatagaaataatctcatccccagacacctccggtcatatgttcagtaatgccccccac

SEQ ID NO: 391939 - DNA, 715 bp, Homo sapiens
cagaaaccagagattctcaaacttcagtgtgtgtgtcagaattacctagagggcttcttaaaagagaccactggaccctaccctcaatttctgatttaacaagttctctggtgatgctcaaactactggccgggtgaccacagttttagaaaccctgtgctaagttatttggttcatttggttggctgtatgaccatttctgttcccctggatatttttgtagtctttctcagacttgaaagttcaagtggaatgtgaggagaaataatatttgactctggaatatttttaagaagctcttcatcttctagcttaatgatttgcctgtcctttccctgatatagacattattctgccagacatcataagaccatgcaaatgttgaatgaaaactttgcctttcagccaaaagttttaagttctgcaggtggaataaacagttcattttgaggggaatacagataacctaaaaatctgaagtccaaagtgttttaacgtcagaaacgttttgagcatcaacatgacactacaggtggaaaattcttcacctgatttcatgagatcacagtcaaaacacacaaaattattaaacatattgtataaaattaccttgaggctatgtgtataaggtgtatagaaacacaaatgaagtttttttgttgttgttgtttatttttttgaggtggagtctcgcactgtcgcccaggctggagtg

SEQ ID NO: 391940 - DNA, 267 bp, Homo sapiens
ctccatttcacctgcttcccatttcacctgcaggttagacattaattcagatttcatgctgaacatatttatgtacacactcccccaccccaattattcttctttttttttccccccagtaaggcctgtagtaatggtgctaatgttagtagtaatggtggcttatagttgtttgcagtaattaagtcagcagtagtttttacacattctacttactactgtggttgctgtttgctgatactaccataacaaaataccacagacttg

SEQ ID NO: 391941 - DNA, 587 bp, Homo sapiens
acccttacctgagcaagatgcatctgcttggtctctctgtctcctccattgcccctctcaaggccattttccactgagctgtagagccattcgtttatagccctgcttagccccctcaagtggccccctgttttgtctgtacaaatgaagtccaaattcctcagcacgcatacagtcaagcgtctttgagatctggcttcaccgttgtcccattccctatccagtgtgcttcccagccaggctgaacttcttgcatttcccaaaatgccgttgtgcccttgtttggttgttttctgtgcctggaatgctgccctatctgtacctcccctggtttggtagatacttgctcatttgttaagacctggctcaaaagctacctcttctatgaagcttttcctgattacctcctcctctccagaattgatgacctcttcctttggactctcagtatcacatctatatttatgtgccagtgcaggtagcattttattacactgacttgttagatctgtaagccacttgataagggctgcacgtgtatcttgtccccagttgtacccaaacttagctctgtgtctggctggaaa

SEQ ID NO: 391942 - DNA, 192 bp, Homo sapiens
aggctgaaggggaaaagggaattactgagaatgatgtgggagcagtagaagaagagagagaggaaagtgtctgaggggaatcagaaagggttaccagcaccccaaaatcacacgcaccatgtagtgaggctgcctgtgttacacacaccacctgcaatccccatcaaccccactaagtccagaatagccagc

SEQ ID NO: 391943 - DNA, 514 bp, Homo sapiens
caacattaaaaaaaaaaaagaggaataatgttaggctatttatttgagatactattattatgattattattttagagactgggtctgactctgtcacccaggctggagtgcagtggcatgattatggctcactgcagcctggaactcaagtgatcctcctgtctcagcttcccaaagtactgggattacaggcctgagccaccatgcctggcctcttcttttttaatgtaagaatttattgctatcaacattcttcttagaactgcttttgctttcgttgcatcccctaggttttagtatgttatatttccattctcttttgtctcaagatacgtttctcttttgatttcttctcaaccaatctattggttgttcaggagcaggttgtttaatttccacatctttgtgatttttccctgaattccctctgttactgatttctagtttttttaccattgtggttggaaataatacttgttatgatttcagttataaatttgttaagacttgtttt

SEQ ID NO: 391944 - DNA, 405 bp, Homo sapiens
agacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactggtaagaatgctgaattgtcaatgaagaattaaggctatgtcttaatgaactttagagat

SEQ ID NO: 391945 - DNA, 785 bp, Homo sapiens
cttatatgctagaatagaaactagttgtcattatttctctttttaacttatgctacatggtttaaatgtgtttcttttgtttttttctttatagtagcatataacactcctattaagaggtctggtaagtgccttatcttatccagcagatgattgtaggccaggggtctgaccagtcactatcattgtccatctcaaatgaacccccatggacaacctcatccttttaatttttcgctaacatccgggctcaagagaacttcagagtaaaagtcatttggaatatatataggtcattcctatgtatactcccttgtttcctcaacagtcagttaaagcactatacattttagtgttgctttattatttttttttccgtaagtattaaattagaatggttttctgttttgggctttgatactcaagaataggagttcaagtgcatttttctgtttggatatattgtattgttatttgttttttcctcttgaagaaagcattaaacctttcgaaaactgcttaaaaagcaaaggccttcccctgtgacctggaacaagacagggatatctacttttaccatttctattcaacactgtactggaggtactaggtaggacaattaggcaagaaaaggaaatagaaggcattcagattggaaaggcagaagtaacactatctttatttgtagatgacatgatgttatacttagaaaatactgagtaatccactaaaaatctattagaactgacaaatgaatccagcaagtttgcaggatacaaccatgt

SEQ ID NO: 391946 - DNA, 654 bp, Homo sapiens
cagaatggcacaggataggaaggggaagtggaagagatggcaagccagtgccagcatgggctgaatgtaaccagtcactgtctagataggaagggctggtggcactcatgtcagtggatgagatcagcaatttgtcattttacttggcatttacaaaatgaacttggagtttggtttgtagctaaagttaggttggctgctcagcttgaaatggaaacatagccaatgaaatgattaatatacatgttgggtcccacagttttgtacctgaagcagtgcaaggcttgggcatattgattccttcctaggagatctaaagaaaaatcccttgaatcaagagagagcttattagatcagttttatccatggtatatccctctatttttgttttttaagtattaaatatttgttagactcaattttggtttgttgactgtcatgatagaggacttgcagagtctgtgcttggtgacctaccttgtactgtcttgttcttcacactttgctgcatcttctcccatatgtaattgattcatttgtttgaattttgaattttggagcctattacatctccctttccctcccagtctccttgatattcccttgtcctccccatttagcagcctttttgaagctgattaccaccatggaggc

SEQ ID NO: 391947 - DNA, 219 bp, Homo sapiens
ggactgggacggagagactgaccttggaaccggatgcaggagggtcatcagtgagaagagtttctggggagtggtggatgcgggagtctgtgttgaagctcaagacagagcgaccctataatttatagtcaaaatcaggacccttttttttttttgagatggagtctcgccctgccacccaggctggagtgcaatggcgcgatctcggctcactgcaac

SEQ ID NO: 391948 - DNA, 134 bp, Homo sapiens
cattctcagaaatctagccagagaaagtctaaatggtaaaggttccagctcattatcttcttcccttttctcaagttttctctccatctgacatgtgagctcagtatttaccattgccctttctacaaatttaa

SEQ ID NO: 391949 - DNA, 661 bp, Homo sapiens
ctagaaatggggtgcacagagatgaacaagaaagagcaggtccctgccattgtgcagctcacaaggagttggaggaaacaggcaatacacaatacatgcatcactatgggtagtggaacatgctctgcaggaaacaaatagggtgatccaatggaaagtcatcactggaggaatgagctgctcagggaaggcctcttccttccatagtgatgtggtctgagatttagaagacagggaaggaccagttataggaagaaccatgggaagaaaattctaggaggtaaagggaagaaccaaggccctgagttagctgaagaaaggagggtggggaatgcgggagagagggatgggagcaggatcgctggtgcctcacaggctgtggtactgagaaggacagttgggacatcattgaagggttttaagcagaagagtgtcatgatttgattcatgttttgtaagctcattctggctgttgagaatgaattctggggagaggcaagagtggaaactggggaccagtgaggagtttgtggtcatagtccagactggacatgatgatgacactgagatgacaatgatgacaatgacaatgatgttaagaatacaaacagctcacgtaagtgccaggcattctttgaaaagcaatgcatttaatcctcac

SEQ ID NO: 391950 - DNA, 253 bp, Homo sapiens
aaattctgatgaatgttgaagtttgagaatcatggatctcacggaaaaaagcatcgtgattccagatttatacagctacgttgcttgctctcttgctcaggtaatgaggcagggagtgttaaacaaagtaactaggtttaacactccgacttccttgagagctcccaaattatattaatttcctcatcttcccaagcaaatggtccctttctcttttgttcatcataatcactgctaaagcttttaatataga

SEQ ID NO: 391951 - DNA, 256 bp, Homo sapiens
catatgcctatctagttctcaacattgaacaatacttgtatcctaggtagaaagcttgatgacaggcagcacgcctcacggcagtagagacagacaatactcccccataacagttaataatcaccatgcaggccaggcatggtcttatgcctgtaatcccagcattttgggaggccaaggcaggtggatcacgtgaggccaggagttcaagagcagcctaggcaacatggtgaaaccccgtctctactaaaaatac

SEQ ID NO: 391952 - DNA, 154 bp, Homo sapiens
ggaaaatgacgttgagaattggacgttacactacaatgtagtcctccaatgaaggctctcaatgggcatttctttaaggcctaagttaaagataaaatagaacaacttccatcactacaaaagatagtgtactcggaggaacttgtagagattt

SEQ ID NO: 391953 - DNA, 550 bp, Homo sapiens
tgcttcgagacagggaagggaagacggatgtcaagatgacctttccaatgcctggcaccggagacttggcaccactcagctcacggccacctccctcttggcagactggaggccttcagggcccagcaggccctgacagcaactcctgcagttcatcaagacaagggcctcagctctctcagcctggccccagggacttgcagcacatcctcagggcatgctgcagcctgactgaacgcaccaggtgaggaggaggcccaagcggggcagttctcgttccttggatagttctagtcttctcgatctatcaaaaataaactcctgtggggagctcagattgggccagcttcaggatgggcacaggaggggaacagttatctgctgtgggtgcatggatttccggcaccttgctttttgccaacaaggtcacaacgtgcacctggtgtttccaagtgaggagggaaggggcagaggccgggatggagggagggttggaaagtggtggctggagaatgtgtgaggactcattccagaaatccctacgctgccc

SEQ ID NO: 391954 - DNA, 171 bp, Homo sapiens
taacaaagaaatatcacacgtaatctacactacagaccaaatcgacctaacagatatttacagaacatttcatacgaaggtcacaggatacacattcttttcctctgcacacagatcattctcaaagataggtcatgttaggtcacaaaacttgtcttcaaacgttcaaaa

SEQ ID NO: 391955 - DNA, 397 bp, Homo sapiens
tccaacagtgttgcctctggggaagaaaactacagtgtggaggcgaggaagaatggaggggagttggtgttccctatttattctttttgtttgtttgtttgtttgagatggagtctcctctgtcacccaggctggagtgccgtggcgcgatcttggctcactgcaacctccacctcctgggttcaagcgattcttctgcctcagactcctgagtacctgggacaacaggtgtgcatcaccacacccagctaatttttgtatttttagtagagatggggttatgccatgttggccaggctggtctcaaactcctgaactcaggtgatccacctgcctcagcctccctatttattcttttgcacctttttaatgatttcctagttgcatgtatcaccta

SEQ ID NO: 391956 - DNA, 322 bp, Homo sapiens
acgtctgtttctcgctcctaggcaaggttggcctcttgcacctctttccatagatcccagctctgcctttggggggtgcaggcctgtgcacctgcaagagggcccagcagtgcccagcccctcggagcccgagtcagtgagagcacccaggaccgggaccagaggcccccagtcagcacagctgcttcaaaattgaaagccaggctgggcgcggtggctcacgcctgtaatccctgcactttgggaggccgaggtgggtagatcacttgaggtcaggagtttgagatcagcttggccaacatggtgaaaccccgtctctatt

SEQ ID NO: 391957 - DNA, 224 bp, Homo sapiens
tataaactcataggtggcacctgtatcctagaaggtaaaactcaaacagccagccatttggcagccgtctgtggaacaggccagcaggaagataaacaattgctattagatctgggactgtgggaagcaaggaaactgggctttgctttgggaacctttttatggaagattgggagaactaaaagctccctaatgagtttaaagtttagcattataggaaaagc

SEQ ID NO: 391958 - DNA, 483 bp, Homo sapiens
tgggctcaagcgatcctcctgtgtagctgggactacagtcgtgcaccaccacacctggctaatttttgtaatttctgtagagacagggttttgccatgttgcccaggctggtctcaactcctgggctcaagcgatctgcccacctcagcctcccaaagtgcttggatgacaggtgtgagctgccgtgcctggccccaattttgtttacctcttgagttttctgaatttatttcaccatattgcccctcccttcctttgacgagcacagtatgggaaaacttgtacaagacatggaaatgggcttctggaaggagaaagtcagcttgtcaatgatgagcaggattagggcaggagggtcccctgcctcctcacagggtcaccgtgtaagcaaactcctgcggcagaagtgaaccaagttggaggcagggaaagggcagaaaaaggaatattctggcaagaagaggggcataagagaaagctgaa

SEQ ID NO: 391959 - DNA, 268 bp, Homo sapiens
agggggagaaacagctgctttctagagccctcaccttttccacttctctcatctttctgggttagggtctagcgggggttccatgaggatcaggctaaatgagcttagaaaaactaagcagactactgtatcagaactggatcacagtagacaggcgttttcaacaaacatatattgagtatccctgagtgctttggacaggaagaggaattatagacgaagattgtaagtcgcagtaatagatgaggcaaggagcaccagtgaggac

SEQ ID NO: 391960 - DNA, 182 bp, Homo sapiens
gcggccgcctactactactactgctcgaattcaagcttctaacgatgtacggggacatgttggtcctctgccctggacctgtgacattctggactatttctgtgtttatttgtggccgagtgtaacaaccatataataaatcacctcttccgctgttttagctgaagaattaaatcaaaaaa

SEQ ID NO: 391961 - DNA, 457 bp, Homo sapiens
ctgtatcagttcctcttctaacaaactacggtctttcttgttgctactcgataatcgctctctcaccttttcatccagaagctttgtggtgttcacataaggacttcagtgctttcagcacttccactatcgctggacacgcctgctggagactgcgcttgtctcttcaccacggtcatcctaagagaccgctcatgcctggagacaaggcattccaaatgctctaacagcagcctgaagtatattctttagaatttcatttagtaagcaagttatattaattcttctttgtctgaaaatttttttttcaccctcattttcaagaagcaggaactggccagttcctgcttctgtaagaatcctgaatttaggattttcaactgtcactactccaacttctatttctgaaggtttgaaatcaattgatagaacagtagacaggcatgtaattgcagtt

SEQ ID NO: 391962 - DNA, 806 bp, Homo sapiens
atgaaaggggcttttagggtttgccagcagtagataagacagatgtagagagcagcagcttggatggagggaactcagaaatgagctgtccaagtaggattttttaaagtataattttttttattaaatgtgataaaacttccttttcaccaggcttcctaaagacataaattatctttcaaggtcttgggaggtagattcgtgtgtctgattagcgtgggttccacatggcaacaggcctcaaagcagaagcacacagtacttgatttatttgttggggttacacaagcttccctgcctgttctgctgtgggacagcctggagtccacacccacactagcctatttttggtctgggttgggtagcttacaaggaaggtaagaggccaattgaccccttatcagtagtttcattaaccaagccactcccagatttttatttgtttggtgggaggtctgggtcatcaagtggggaaacttccccagaacaagctactaagtctccgaacaaaggaacacaaaaggtgttaccattttttcctgaacaattggtgggttttttgtttttgtttttttttgacagagtcttgctcttttgcccaggctggagtgcagtgatgtgatctcagctcactgcatcctctgcctcctgggttcaagtgattctcctgcctcagcctcctaagtagctgagattataggcgtgtgccaccatgcctaagggaggagaccacccctcatattgtcttaagcccaatttctgcctccaagaaagaagtaaaaactaaaaggcagaaatgaaatcca

SEQ ID NO: 391963 - DNA, 198 bp, Homo sapiens
ttctcttacatgtatctgaaagcattctaactcataggccctgcagtgcacatggtcaaatctctgctcagatacctagattcctttttctatttttgttcctcattccttatacccattttgcttccagtgggctgtacccatgacactcctcagggacctgcttgtttgctcaaagagccagaagtgccttgaatt

SEQ ID NO: 391964 - DNA, 180 bp, Homo sapiens
agaggctgaaggcagagcccttcaaaatatcaacattaaggaatgggcataggaagaggatatggagaatgtattgctgaatagaaagtcaaccaaaagagaagggacccatagaaacggagggaggagaatgttttaataagaacaaggtggtcaaaagtgtcacctgctccaaggact

SEQ ID NO: 391965 - DNA, 261 bp, Homo sapiens
gggacttcaggcaagcactggcttccctcaggctctgctcctaacctctcaatggcagtagggggcagaaggcaagacatgggccatggggaaatagtttccagttttcagatagagaaattgaaatcagagtataccatttgggaaaacttaatttaaaatttaaaattcataagaatttataatgtgactctcaggcaggctttaatcgcatttggcagattaaccatgctaggcacattgtccagatagcggccattg

SEQ ID NO: 391966 - DNA, 240 bp, Homo sapiens
tttctataattttgaaccttactcattagcaagttatttaaggtgtgacacatttcacgtaatgctgttgtgattcataggaaccacataaatagagaccacatgtttcccacttaagttatcaaaagtcaacacaaacaggagtgatgactatgtagtcaaacagccacaccctgccttgtatacaattttttcttctctttcttgtttgcccctttccttattttcctaaggcagtta

SEQ ID NO: 391967 - DNA, 746 bp, Homo sapiens
catagtggctcacgcctgtaatcccagcactttggtggggggctgaggtgggcaaatcacttgagcccaggagttcaagaccagcctgggcaacgtggtgaaaccccgtttttgtgaaaccccaaaaatacaaaaaatcagccaggcatggtggtggcatgcctgtggtaccagctactcgggaggctgcagcgggaggatcacttgaacccaggaggcagaggttgcagtgagccaagactgcgcctctgcactccagcctggccagcagagtgagaccccatctcaaaacaaacaaacaaaaaataaaattacacatattaaaacttcaagataaaacactgagttatcttacattctttgttgttgttgttaagtctttgaaattgagtgtgtctcaggcaaatccagcacactctagtctggaggagccatgtctcaggtgccgtccagtgcatgtggctcgtcaggctgtcctggacagcggctccagcctctgacctcatcttctatcttcgtccattccccttcctcaggtgatgcattcgctgcaccacctaagggggtaccacgtttgtcagtctcagctacgggacctacaaagaacgcccttcataaccctggcactcaggccccacgtgcccctgagggagcacgagaagagcggtgaccttgaaatcgattcactgaatatttgctgaacacctactacctgattaacacagataggacagttatcatcctca

SEQ ID NO: 391968 - DNA, 237 bp, Homo sapiens
ggggacaaagtaacaaggggtgatttttcaaaagggaagcgagggaagcccctctgacaaggcgataatttagatacggcctgagaaaacagagggagtgagccacataggtatgtggtaaaagtgcattccacacagagggaccagcaaacaccaaggctgcaagcagaggatcgcattaaccaaagatgtggtgctgagggtggaatgtgcctagtgctgtgtgaggtgggagat

SEQ ID NO: 391969 - DNA, 501 bp, Homo sapiens
aacgaggataaaagatgacgagatagacattgttctgtcaaatggttaactttactttggagggttttaatgttttaacttttgggattaaagatcctcttcatggaatggagactaaaatatagtttaaagcccagctattttccagcaataatctaaaataacatttgcaaaattattcagaataggtaagaatggtacttactgtttactggagcctcttctttaagacggagttttcgctcttgtggtccaggctggagtgcaatgaatggcacgatcttggctcactgcaacctctgcctcccgggttcaagtgattctcgtgcctcagcctcctgagtagctgggattacaggcgcccgccaccacgcctagctaatttttgtattttagtttcaccacgttggccaggctgggctcgaactcctgacctcaggtgatctgcctgcctcggcctcccaaagtgctgggattacaggcatgagccactgtgcccgg

SEQ ID NO: 391970 - DNA, 195 bp, Homo sapiens
tggttaatggattatttcataatgttcatcagaagctgcgactcagttgatggcattacaggaatagagtgcaatctgctaaggaaaagtaatgacaagagagttttggtgattaaagaaatttaaaatcactgtattaaatcagcttaataaaaaacacacattggctgggcacggtggctcatgcctgtaatc

SEQ ID NO: 391971 - DNA, 305 bp, Homo sapiens
gagccctgggaatggtgagcgaaggatagtcgttcagatattatcagggggtcagcgaggcctccaaatgggagtcccaactaggacacctccacctgcccagtgactagacaccgggggcattgccaagcctcaggcaacgggaagaagacaatttggtcgaaacaacaagagggttagaaatgaatgttcctgggatgttctaaatcttgaagtaggtgctagacacacaggtgtatctgtgtgtaaaaactcatggcatggtacagtgaagatttatgctaacacttatatataaatatttt

SEQ ID NO: 391972 - DNA, 513 bp, Homo sapiens
ggtgagtaacctagcagacaaaatacttcagctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcaggggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaa

SEQ ID NO: 391973 - DNA, 729 bp, Homo sapiens
ggcaaggaggatgtgcacacagtgctactggcttctagtgagtagaagctaaggaagatgctaaattctacaatgcacaggacaaagaattatctgacccaatatgtcaatagtgccaaggctgagaaaccctagtctaataggatatgagactgtcattaaatggtattatgattgaggctgaaggaacaaaaagaatctagaagaatgcagaattcaactgggcaataaagaaattaactgaaagcaatcaattgtcggaaactgaatagcccagaagaagtagatagtaagccaatttcgactgaaaagagtggacatggggtccctgttgatgtagcactcaagttggatatactcatttgagtagcatgtgcccttcaagtcctatgtatgaaccttgaatctctgaagaaaaatttaccatgctgtggtcttgaattttcaagccagtaacctcggtgtacctgagccggtaaatctcacccccttccttgggtaaatatccttaagtgccaggaagatttagaatttagtataagaatgacaaaagaaaccaacttcatcatgttaaaaccaggtgttaagttcagggtaacctgtatgtttgttatttaaaatagtgattgtaatttttaagagactctgacatgctagttttatgcttttaagcaaagttgtaggataatttcattaaatgtgagaatgatattggaatgttggctagaa

SEQ ID NO: 391974 - DNA, 517 bp, Homo sapiens
ggcttgaacctgggaggcgagggttgcagtgagctgagatcgcaccactgcactccagcctgggtgacagagcgagacttcgtctcaaaaaaaaagaagaagaaagaaggaagctgaggttcagacaggctaagtccctactgcaggctgcggaatctaaaaaggtcatgaactctgagagtttgagatgagcctctaaaagctgtatcaatagcaccttgcactgttgaagcaggtaagtgttttccttgttacttcttaagttcagttggaaacccaacatagcaaatcctctagaatgcagctgaagcagtactaaggctgggtgtggtggctcatgcctataatcctgtagggaggcaaaagcgggaggattgctggagcccaggagttcaagaccagcctgggcaacacggcaagacctggttctccacaaaaaggaaaaaaaaatgctaagaggcaagtatatagcaataaactcctacatcaaaaaagtagaaacatttcaaataagaga

SEQ ID NO: 391975 - DNA, 707 bp, Homo sapiens
gggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaag

SEQ ID NO: 391976 - DNA, 333 bp, Homo sapiens
atacaatggactttgggaacttggggggaaggatggaaaggggatgagagataaaagactacacattgggtacagtgtacactgcttgggtgacaggtgcaccaaaatctcagaaatcaccactaaagtacttatccatgcaaccaaacaccagccgttccccaaaagcttattgaaatacaaaaaaaatgtcagctatatcactggtgaatgtggctgggagatatgacttaagttctgaagtcacaagagcctgctgggttagactcacccacctggtcacctgaatggctgggtgactgcaggcattccccaaagagccttctgtctgca

SEQ ID NO: 391977 - DNA, 849 bp, Homo sapiens
gcagattaaaccagctgtcaagccagggtgaaggatccgtggccaggcagaggtctgtggagtggagaggcgaggcctcacggtggaactctcagatgtaagtaatttctgtgttcttcttttttaaaaagcatgtctagtctgacagtttttcagagcttcagaatttctgctgcatggcaggaactgtgacggttggaagaaccattgtcagggtcaccttcttgttgcatttgcatttcctgaacataatgtacatgtatgagtggctttcactatgaaacacttttttaggcttccaggcatatgaattcctctttactgagattctgcctttaaaatgaaagattttcagtgcattaagcaaagaatgacatggtcttctcatttaaaccctaaaaagataaactcacttaaagctaatataacagatagctccttgaaatcttgtctctattttaaaacatctggctagacttttccattagtcttcaatgctaaataacaattaaggaaaagagatatgatatctcttttccttattgtgatcacaaacaaagaaaagtgagaactcccaaaacaccggctgatactgtttctttgctctgttttatcttttaataatattatatttactgcctatttacacaccaggctttatagagtttgctgattagaaaacaaagaaaagaaagtaagctaagatgagcattaacatttggattggatagttcgtgtttttaaaaaattggtcttttattcaaaagtgaaaaagcatgataaataatgtagcaaaaggcaagatgaagaggggaatgttttaattcaaaatgagtagaacatatacag

SEQ ID NO: 391978 - DNA, 1098 bp, Homo sapiens
tggccaggcagaggtctgtggagtggagaggcgaggcctcacggtggaactctcagatgacagcatgcaggcaccaagagagtggacgcacatacagaagacagccatgcactgagctggggacatgcaacaataacaggtgagttccaacaaattggttcaaaaagaggggggataaacacgctggcccatgctgggcaagcatggcaccaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccaacctgatgtgcaactgtaaaaccgtcctgccccttgcagtagagcgaaccagctacaatggccatctgaccatctggttcacggacacatctgcgctgggccacctgctgaacttcacgctggtccaagacctgaagctttccctgtgcagcaccaacactctccccactgaatacctggctatttgtggtctgaagaggctgcgcatcaacatggaggccaagcatcccttcccagagcagagcttactcatccatagcggtggggacagtgactccagagagaagcccatgtggttacacaaaggctggcagccatgtatgtatatctcattcttagatatggctcttttcaacagggactcagccttaaatcatatagtattgaaaacgttaccagcattgccaacaactttcctgacttttcttactttagaaccttcccaatgccaagcaacaaaagctatgttgtcacatttatttactagcataataactgtgtccagctgcctggaactttggcaaatgatgaataatttgcagaaggaatctggaaataaggccgtgagataggtatccctacccacaactgtgcctctctccgcaggctccatttgcaacacagccacacataccaataaccagctctctgttctgctctgtgcccaactgcgagaacacttttgaaaaacaaaagaaaaagaaaccaaaaaaccaacttgat

SEQ ID NO: 391979 - DNA, 388 bp, Homo sapiens
tgagatggagtctcctctgtcacccaggttggagtgctgtggcgtaatctcggctcactgcaacctctgcttcccaggttcaagcgtttctcccacctcagcctcctgagtgtgtgagactacaggcacataccaccacgcctgctaatttttgtatttttagtagagacggggtgtcactgtgttggtcaggctggtcttgaactcctgacctgaagtgatccacctgccttggcctcccaaaatgctgggattacaggcgtgagccactgcacccgatgagccatggttttcaactaggactgctatacgttagaattacttgaaaaattatagagataattcaagaccctgcctgttggcttcatttgaggatttggcaggcagt

SEQ ID NO: 391980 - DNA, 211 bp, Homo sapiens
gtgccctgctgcttgcaaatgtcctgagtgaccagtctgggctccctgtccagtgcaccccgacatgttccctgggatgaattcccagcgtctccctctgctcctgtcacatgctgttttgaggaaccatccctggctccctgttgatgattcctgatgtacgggctgcccaagcacaaccccttcaggcgtgggaagccgacttccttcc

SEQ ID NO: 391981 - DNA, 393 bp, Homo sapiens
cagataaaaacaagaataaaaataaattagctaggcatggtgttgcttgcctcaggaggctgaggtgggagaactacttgagcctaggagttcgaggctgcagttagccacgactgtgccactgcactccagcctaggtgacagagtgagaccctgtctcaaaaaaaaaaataaataaataaaatcacctttataatttacagaactttacaataaattttgaaaaatcaaatgcataaagtaatttataatgtaatatctacacaattaaggtacagaacattttcatgcctccaaagggttccttcatgctttttcataataaaatttcttccatttaaacctggtaaccactgatctgatttgtcattagttttgtcgtttatagaatag

SEQ ID NO: 391982 - DNA, 399 bp, Homo sapiens
acagaatttgtttctttcagtatagtgaaatcatgaattcaggtagtaggctagaattcttgtttgagtaatctcaaaatatctttattcctttttttctccctaattggtggaagtggtaacaagtttctcttcagcacccctgacttagtaccctcatgattgcaggcttagtctaacagcagtgagttgacaaagttcaggaaaaaaaatttaagtagaatgcagactttttcgtctgcccattgttaaaaaaaaagtcagaggtttcttttatgaatgctaattcttgaggcattattgactgatattgaaacttaaaaacacatcagccaataatgaaatggtactgcttttactttcactttccttccaggtgagttgtaccttgcttcacag

SEQ ID NO: 391983 - DNA, 118 bp, Homo sapiens
caaaccctttcctgaaaaattcaaagcatttttaccaaaattttctaaatttatattgccaatattttggtacttggaatttagcaaaagttttcccacattctaaactttagagaat

SEQ ID NO: 391984 - DNA, 717 bp, Homo sapiens
aaataagtaaaaaataaaagattcagactcggaaaaccaggcttctgagcaaggagtccagcgcggggcacagaccaggaaacatgggagaagaggtctcaagtgatgcagaggagggagcgataaactttgccaggcaatcaggacagggatgtgctagcaaggttttgaaggatgagtaggagtttgccaggggaggaaagtgagctgatttgtttaggttcctctgtaaagtggggaccttgctggatggctttttgtaaagtactgagaacagggcctggcacatggtgccatttaagatgatgatagcagtaataacacactatctaagcccacagcctctctgcctcctatgggcagcaccttgaaggtgcctgaaacccagaacttcagatctccagggtcatttattctgtttaagttcagaggttcttctgcctccaggcagctcctggtctgggccctgactctgaattcccactgggtgctccagttgtgaaacccactagcagtctatatcccaagtgttttccctggagaggccagccccagctgctcacaggaagaacctgagttgggcgtggtggctcacgcctgtaatcccagcactttgggaggccgaggcatgcgaatctcttgagctcaggagttggaggtcagcctgagcaccatggcgaaaccctgtctctaccaaaaaacaaaaacttttccggg

SEQ ID NO: 391985 - DNA, 620 bp, Homo sapiens
gtttttaaaaccagttttagtttcacagcaaaattgagcagaaagtacagagagttcccaaatacaccctgtcttggtacatgcacagcctctctcatgatcaaaatccaaaacacattggtacatttgttgcagttgatgcacctatacatcatttgacaatgtgtcaatgatgtgtcactcaaagtctatagtttacattagggttcacttttggtgttgtacattctatgggtttggataaatgaatagcatgtatctgccattatagtatcatacagaacagtttcactgccctaaaagtcctctgtcctctgctatttatcccgccctccccattaaccactgatctttttactgattcttttactgtatcaataattttgccttttctagaatgtcatatatttgaaatcaaatagtatgtagctttttaagattagcttctttcacttagtaatatacctttatgtttctttcacgccttttttgtgggttgatagctcatttctttctattgccaaataatattctattataaggatgaatcataatttgtttatccatatgtctattaaaggaaatcttggctgattccaattttgggcaattatgaataa

SEQ ID NO: 391986 - DNA, 216 bp, Homo sapiens
ccagtgggaggtgatgctccagctgcatgtacaggagacatgagaagtaagccaaggggacagcagggcaaaggcatgaaggccagggaagtgtatggtatatggcacctcagtgtttcaggagcatagagcggaaccctgggatcaacaggtggtaagaccacagcaggtggggccaagtcccagcaacctcatttgacataggagcttgggcct

SEQ ID NO: 391987 - DNA, 177 bp, Homo sapiens
gccactgcactccagcctgggtgacagagcgagacttcatctcaaaaaataaaaaataaaaaggtatgtgtagtaggcattgctttttctctttgtagataatactcaggaggactgcctcttgaacaaggctaacctgctgagcctttgaagcaaggaactggagatggtcctttt

SEQ ID NO: 391988 - DNA, 335 bp, Homo sapiens
gtgagccactgtgtccagcagaaaatgtactttctagaaagaaaataattggtacttcactactttcccagggaattccttcaggtgaatgtccacccttttgatctagaagcagactcacaattttgtttgtttggcaaatcagcctctgagctcaacttccttgtctgtaaaatggggctaaggaaatgtgggttgctttttcaaaggttactgttaggatggaatgagatcatgtgtgtaacaaaggctttggaaactttctggaatttgaaggctatataaataaaagatggaccactctttccttaaatttggcacctttcctgttcttt

SEQ ID NO: 391989 - DNA, 158 bp, Homo sapiens
attctctcaaagggcagtctcttggtcccacattggattgaagccaaatatgtctccttatgatttgtagtcactggtccctgttctgcagggacctaatatcctccatggtaggccctaggatatttaagtaaagtgcttaagtgtgtcttgaggct

SEQ ID NO: 391990 - DNA, 278 bp, Homo sapiens
cccgtgagcctgggtcatttgcttcaatcagccaacatttatgaagcgtctgctggtgccaggcctgttctaggcgccggggacaggccttgccggaacctgaaggaggggaggagcagctgtgggaaagggcgttccaggcagagggaacagccagtgcagaggccctgaggccagctcagcttgagagatcactgtgcccccctgggagccacaggacttggtccctaaacagcaggagttcaaggccaggcccgggcagtttgcaattcggtctc

SEQ ID NO: 391991 - DNA, 236 bp, Homo sapiens
tctctgtgccccaactactaagcaggatttataccaggctagggaagctctgtccataagggctacctaaggggcgttaagtgtactctgtttcaggaagacctctgtgaataactgcatagaacattagaaatcatatacaggtccttagtacttacacgtacctgcttagaaaggtttcttttcccccttagagatagggtcttactatgttgcctaagctagtctgaaactac

SEQ ID NO: 391992 - DNA, 435 bp, Homo sapiens
gaagcctcagtagccgatgcgatcaactggaagaaagggtatcagtgatggaagatgaaatgaatgaaatgaagcaagaagagaagtttagagaaaaaagagtaaaaagaaatgaacaaagcctccaagaaatatgggactatgtgaaaagaccaaatctacgtctgattggtgtacctgaaagtgacggggagaatggaaccaagttggaaaacactctgcaggatttataccaggctagggaagctctgtccataagggctacctaaggggcgttaagtgtactctgtttcaggaagacctctgtgaataactgcatagaacattagaaatcatatacaggtccttagtacttacacgtacctgcttagaaaggtttcttttcccccttagagatagggtcttactatgttgcctaagctagtctgaaactac

SEQ ID NO: 391993 - DNA, 380 bp, Homo sapiens
acagagaccaagattaaaaccactgggttatatgaaggaaatacactaaactcaaaacaagtattctatgcatacaattaaaattaaagatatgaatttgtaactacgaaaaaaaaaaaacccaaccatcgcagaatatataaagtaggaacaaggacttttaaaatgaaatgattttagcatgttgcctcccacagagttttctctaactatgggatgtagatttaaaccacaccagagaaaatagaatcaagataggaattctcacccattccaacttaagtctcagatgacgattatgttaggaggtccacatatgggaataaagaacttttggggctctaagcacactgactctaaatgaagcttgtggtatccca

SEQ ID NO: 391994 - DNA, 510 bp, Homo sapiens
ttctttctttctttctctttctttcttttcttttctttctttctttctctttctttcttctttccctctttctctccttccttccgtctttccttcttttcttttcttttctttctctctttctttcctttctttctttttctttctttccctctttcttttctttcctttctctctctctctcttttctttctttcttttgacagtgtctaacgctgtcaccctagctggagtgcatggtgttcatagttcactgtagctttgaattcctgggctccagcaatcttactgcctcagcctccaaagtagctgggagtacaggcatacgctaccacacccgactaatttgaaaaaatttttttgtagagaagtagtctcttttttttcttttttgtagagatggggtcttttttttttcttttcttttctttatttttttgagacggagtgtcgctctgtcacccaggctggagtgcagtggtgcaatctcggctcactgcaagctctgcc

SEQ ID NO: 391995 - DNA, 339 bp, Homo sapiens
cccacctcctaagtctatcacattgggaattagatttcaacataggaattggggtgggggaggcacattcagaccatagcattctgccccagactctccccagttcattttcttgtcatatgcaaaatatattcattccatcccaataggctcccaaatcttaacttgttccagcatcagttcaaaagtttcaagtccagagcctcatctaatctcacctaggccaggcacagtggtcatgtctgtgatcccagcactttgggaggctaaggcaggaggattgcttgaggccaggagttcaagaccagcctgggcaacaaagtgagaccctgtctctac

SEQ ID NO: 391996 - DNA, 186 bp, Homo sapiens
tgatgtgtcatgcatattgatttgtgcatgttgaaccatccttgcatccctgggatgaatcccatctgatcatggtgaaagatctatactcacaatattgtacaaccatcaccactatctatttccaaaactttttcatcacaccaaacagaaactctgtacctaccaagcaataactcctcatac

SEQ ID NO: 391997 - DNA, 550 bp, Homo sapiens
gctgcctccaagctttcctgactgcagccttttctccagtcacttttgatagaggagttaagaagaaattacttaggcagatagtgagggtatggaagtcctcggtaaggttttccttttaatgaaaagcagccccaaatcattttcctttctaacaaacagcagcctgtaaaatcaagctgcagacatagatgccggcagttgtgccaatcatgttcagaatggtggctcccttctcccttctctgccagccatatgtacagtaaggagcagacaacatggctcgggccaagggtaaagttgatttgcataataagattagggtggggcccaccagccttcccctgcactatgtaaacatcacgcctgactgaaccaatctgtgagccctatgtaaatcagacaatgccttctcaagcctgactataaaatcctgtgagtccactgccagccagtctttcctctgggaagcccctctctctccctagagagagctggtttcctttctcctttctttttcttttgcatattaaacttccactcctaaact

SEQ ID NO: 391998 - DNA, 263 bp, Homo sapiens
tgtaggaaaaaatgtccttgttcttaggaaacacatgctgaaatatttaggggtaaagtgtcatgatgtcttcagctaactctcaaacagttcagagaatacacacgagaaagacatacagagacaccaaataaggaaatctgttcacaggccatggatgcccgggtagttaatgacatggctactggaacatccaaaggctatggttttgtatctatttataagcacactggatgcagaatatgcgattgtgcatattggcg

SEQ ID NO: 391999 - DNA, 310 bp, Homo sapiens
cagagtccactgaaatctcatcacactggaggacctatccaaaaacactcaaataaggccaggggcagtcactcacacctgtaatcccagcactttggaggctgaggcaggtggatcacctcaggtcaggagttcaagaccagcctgaccaatatggtgaaaccccatctccactaaaaatacaaaaattagctgggcatggcggcatgcacctgtaatcccagctactccagaggctgagacaggagaattgcttgaatccgggaggcagaggttgcagtgagctgagatcgcgcaaccacactccagt

SEQ ID NO: 392000 - DNA, 396 bp, Homo sapiens
cctagcacagtgcctggcatttgtagtacctaaaattgtgtgtgtgatggatgaatggtctcaaaacgtcccatctagttaaggtcttatgactgacacacatgaaacaattaaggcagtgccaggtttgtgccattcacagtgactctggtgtgtggccattcaacatcgcaggagtttagagaagacttcatagaaggtgagttaggggctgagccatcacgattgggtaggttgggattaacagaggaaaccagtactaatgagtagaggtggggtgaagagactctaatggagaaggatatatacatgggcaaataacagaaaatcaagtgtgatgggaggtatgggcctctctatacgtcattgaaagcctggaatgggtggggtgggtga

SEQ ID NO: 392001 - DNA, 443 bp, Homo sapiens
tccatgacagggaaagaatcaatgaggaggcaacttcaacccagcagaaaggtgctcagacacggagccctcaggaagaagcaacagagcagtgcttgggcttcagtgctagccagtgttggcaggggaggaggttcccgaggtgcccaaataaccaggttcaaggcaatgtaagaaaggagctaggagaggaaacataagtgaccgaaaagaaaccaaaatgctgcctgtgattgtattacagctggaagattatggcatgatttctttttcgtctgttctcccagtttttgatatgaggtcgttttgtatatacctttaaaaggagcaaatgtaatatactttatggaacactttcaataatgcaaaatatctagaaggaatcaggaacttgtcacaaaaccagtgctggctgggtgcagttggagagaattagagcctgg

SEQ ID NO: 392002 - DNA, 517 bp, Homo sapiens
gttataatgaagaatgatttttttaagggcatatgggcagtctcatacaatgtaagctattaactacctcctttatgaaaagaagccagcctttgccctgaagtccatccatttaaaactgttggaaatctttcatttcctatcaaaccacatgtacctgttcccatgtctgttcacctttgaggaagcaaagaaagtattataaatgagccacaaatggacagtgcaaacagtccctgttcttcttgctgagtgttggttcacttctttatttcgagggccgtggcccagctgcctgaagtcctgctcagcaccagcctagaagaacttggaagtaaacttcatggtcaggcaagattgttaaaaactctgatgaatacacttggtagcagcatttaatctgcgaacaggcaacattactcatgaatttaacagagatgtgttgagcacatgctatgtgcctggctctgttctaggctctgaggagtcctcaataaacaatgaccctgtttcaatt

SEQ ID NO: 392003 - DNA, 905 bp, Homo sapiens
gcttagagcagtggggtctagaaatgggattctggggtcatttggccattccatgaccttgtgcaacagatgcctctctctgggaagtaatttcccctttgatgagttgctacattaagagtttcgggctgttaagaggaatccataacctaatggtaagcacaggcctgagtcagagtaaatatctcttgaatgttaggccattcgcatttattgttgtaataatgattatgttgaatgctaaaaaaaaaaaaaaaaaaaaaaaaaaaaaaaaaaaaaaaaaaaaaaaaaaaaaaaaagggaggaaaataaatcgaggggggggacaaaaagagaaacaaaaaaaggggcaaagagagcgacaagagcggtgaccacaaaacagcatttatgtggaaacacaaaggggcgaacacacggggggaaccccctacatagggcacaccacatataaaagatccgacagcaaaagccagggagaaacacgcgcgcataaaacaacacggcaaaaaagaagcaaaaaaaaaaacaaacaaaaacagaaacaaacagcagaagagaaaaaacgagagcacagacaacaacacgacgagacgggcacaaaaaaacgagacgacaaaaaaaccgacgcgagaacaaaagacaaacacaaagcaaaaaacgcacaccacaaacaaacacacacacaccaaaaactgaaacaacatacaaataaaataaagaaacaagagaaagagacagaacagcaaaaaaacgaggagaaagagaggaaaagagggagggagagaggaaggagagggagaacaggagagggacgagagggcaggcgcggacgaggggagggaagaggaggacgggcgaggaggggagggagaaggagagcggggagggagggaggaggggag

SEQ ID NO: 392004 - DNA, 871 bp, Homo sapiens
cgatcgaggcgtgtacccgccgggttacgctccacctcaagttatgacaaaatctacaacttctttcccctttctggccatggagaacaagtccgctctcctccaaggctccttctggtaggtgagccctatctcctgtctccttcagtccctcccatatggccccagtcccttcgtgattctggctctcccaactacttttcccataggaagctcggatcaatcagtgtccaggtccacctaatgtaaacctcaaactatactgaacctggacttttaattttgtttcccagagtgcaaacatccaaagcaaaaaaggtcacatctcagaatttaactttcagcaaacagaactagaactaaaggaaggagggcaggaaccaagacccctttccgccctaatacgtgtagagcaaaacgtggagtcctgacagagctgtgtgttgcgtgggaaacctggtgcttacaagtttagcacaagtctaacaggtttctgacagcaacaaaaaaggcttcacatgaggggttctacttttttgcttttaaacgaggaagtaattaagttgattcccttgtgataagttttgccaactacatattcaaggggcaacagtcttcgaagagaattatcagtaatactccaggaagaatttcatttcagcctcagttaatgagacccgcaagtgctttaaagcaccagacaggaccgggtatggagggcaccaaaaaagcctccggctgaaacccagacttctcctcttccaaaactaaaattactcaagaccacaaaccaaagttcagaatgggaaaataaaatcctgatccactcagagatcacaagatcgaaatctaggagagaccacaggcgact

SEQ ID NO: 392005 - DNA, 550 bp, Homo sapiens
atattgacaatttggccagttcctagaaatatatcaaaagtgacacaaaaataagtagataactctagtagtcctagaaacttaaaaaaatggaaccatgaaaaccatctgctcatagcaaaagatgtaagcctggtggctctaattgctaaattatactaaatatttaggaaagaaattattctatgttcatacagattcttctactagggaacagaaaagcagatatactccccagatagtcttgtagaaacatgatatagcctagggcagtggctcatgcctgtaatcccaacactttgggaggccaaggtagaaggatcacttgagctcaggagttcgagatcatcctgggcaacatagcaaaaccctgtctctaaaaaacaattaaaaaattagctgggtgttgtagtgggtgcctgtaagtcctagctacttgggaggctgaggtgggaggactgcttgagcccaggaggttgaggttatagtgaactatgatggcaccactgcactccagctaggtcaacagattgagactcttgtctcaaaa

SEQ ID NO: 392006 - DNA, 465 bp, Homo sapiens
taaaaatgaagtgtgcaaaatgccagatgctacaaacgcaattagatacttaaaaatagcttccttggtggcactgcttgaactctgaactgggccttgtttttacaaacagggtggcgcttttctgctatgctcctgattgtgtgctccgataggaggcacggctctgcttctaaggccatcaggcaaaccatcagattgttctagaatcagactaggtgctgatgttttacgacatcattgcagttgcaggcatgaggtttttctctccaggtgcactgtgtaccctcctgcttcttgacctctgatggtttgcagtcaagctgtgtcggcaaaagccctcaaccgactgagtctgacctgcataaagaagatgaagtgcccacacccctcacccctcactttttaagttctaaatgtattccacataaacttttatttcaccagaactcaaacaaccacaaa

SEQ ID NO: 392007 - DNA, 276 bp, Homo sapiens
gtgaacttagtaaactcacttataagtttggagagtttttctgtagtttggggttttctatgttgaccattatgtcatctgtaaatagtaacagtgttctcactttttgatctgatgtcttttatttcccttctttgcattatgtcaccagcttggattttcattactatgttgaataagaattatgagaatgggcattcttgcctttttcctaatctaaggggaaaaagcattcagtctttcacctttgggtagatgttagctatcgatatttgg

SEQ ID NO: 392008 - DNA, 397 bp, Homo sapiens
caaggaaatgtcaggagttctcctaggaacaagggaaacttcagtgagcaaaacacacacacaaaaaaatccttttgcccagacagagctcactgtgtcttcccaactacaaagtggctccaagacatgggatagagtctccctgtgaccaggcagatagaaaggggtgatagaaaagcaacccttgtgatagaaaggggtcctggcagaggtttttcaataagtatcagttggataaagaaatagcacggagcagccaggcacggtggctcatgactgtaatcccagcactttgtgaggccaaggtgggcggatcgattgagccctggagttcgaggctgtagtgagctatgatctcgccactgcactccaccctggatgacgatacaagattctg

SEQ ID NO: 392009 - DNA, 248 bp, Homo sapiens
taattttttgtatttttagtagagacggggtttcaccatgttaggtggtctcgatttcctgacctcgtgatctgcctgcctcagcctcccaaagtgctgggattacaggcgtgagccaccgcgccctgctgataagtatttttttaaaagccctgagaaatgacaatgtaggatttaaaaaatgacttgtattaacagtatgagagtaatatgtgttcaaggtaaaaaaaaaataaataaataaaaat

SEQ ID NO: 392010 - DNA, 285 bp, Homo sapiens
ttatatattatggagtgactactgattatgtcaatagggggattctttgggcttaaggaaagatgttgtcagtgtgttcgtactggatgttcatgtgtatggagtgggtgagctacacaggaagaatcagagtgagagggagcacagaaatgttttctccttaatgtttttagtatctctattctgaatttttaaaaaaccagagctacataattttgataggctagatctgctacagaagtatacacaccatttcacaatgttaacatttagaagttagctttc

SEQ ID NO: 392011 - DNA, 756 bp, Homo sapiens
cccattaaatgaaactgaaggctcttgagaattgaggcagcattaggaactggctactctctccattttctctacttggcctttgtctctctcacagtgactttgcatccctctgcacatcttttgactattctaatccataacttcttctcttcctgaagaattggtgttgactttctcaagaattcccttcatgttcttgccagccacctagcctttctctacagtaggagacagcctcttttcatcccttgccccagccccagctaattagcttaagttgttcagttttgttttgttttccatttaattattgagagaggaaatctgattggcaaacctcatctttgtgcgccaggccatacatatggcagccttgagtcatggcgccacccagatattaatgactttgcttaacatttccatttgtttcaactacctgtaagtgtcttcaaacctttcttgtactgttttgtttttagctctgaattctgtaagtttgccctgaatagtattgtgtatactttggtcataaaatatactcaaagtcaccattccttatgattgaacttgaaatcccttaagatttcatactcactcatatcaaaccaggaagaaaatttcctcatataatgaatacatatactctgacaatcagagctgatgagacagattgcctgaagtggatttaagtcttacttcgcgatctttttcttcccaggatttcctgtggatacgtagcctcatagtgtggtt

SEQ ID NO: 392012 - DNA, 427 bp, Homo sapiens
agaggacgtaaatttcaccttgaatgtattaaggagacaatttgatcttgctccacaaaatgctggtagtgcataggagttgactgagagagcattttgaggtgggatgaggaaggaaagctttatgcaggagatgagtcttgaagagcaagtagatgttaggagctagagaatttgtaaaggggcattctggtctggggggggcaacatgagcaaagttgggcctagggtgagtctggcatgctggggagaaggcacacaccctcctccttgggctttctctctatgatggctgtagcagttgagtcagggtcccatggggccagttgtctccattcagttgactctgcataagcatctttgttgggaccatcccagccatctcatcagactactttgcagcagtggaggatagcacgtgataatt

SEQ ID NO: 392013 - DNA, 196 bp, Homo sapiens
ctagatcacgagttcctggactctggggacactgccctccatatttactcccttggtgcttagcatagggcttggcacagagcaggtgctcagggaaatcctgctgaacgaacaggcatggcgggcagcactttgggtgactggaatatggtataagaccttctgacaaggcctcccaaatgccaaccttgaaaac

SEQ ID NO: 392014 - DNA, 588 bp, Homo sapiens
tgtgggaggaggatgaggatcaaaactacctattgggtactatgctcattacatgggtgacaaaataatctgtacaccaaacccccatgacacacagttgtccgcggaacaaacctgtgcatgtatcccctgaacctaaaataaaagtcggacaggaaaaaataaaaagcagataccctctggaggtatggtttaaatgttgcagccattgtttactttctagcaaataggtttatcagatcttgtcttgaaataagcttccctggaggagaaaggagtttagaagtacaaggagagcctgaggggaagagtagaatttctgtgagaagataaaaggcatgataagtgtatactgaggccagtgagtaataccctcacttgtctcttggatttctccaatagtggatcctgactattcttacaagttcccctatagagtaattgacagtgagatcatcccaggcctggtttgaagcccatctttgtgactcagtaaatacattggttgtcctagtgtgtctggcatttcttgcagccctctgcatggaacttggcgtggccatttgcaaggttgctcctgtgcagtca

SEQ ID NO: 392015 - DNA, 336 bp, Homo sapiens
atatcagggaaggaaaagtagctcaaagcggctggactgtggagagcctaggaaatggggcagggctaagagtaaagccaaaaattaagacacagaagactgagcttgttctccttgttggttttgggggtcccagggaacctctaaagcaagcttgtccaacctgcgccccaggacagctttgaatgcggcccaacacagatttgtaaactttcttaaaacattataagatttttttgcaattattttatttttcttttttagctaatcagctatcgttagtgttagtgtgttttaagtgtggcccaagacaattcttccagtgtggcccaggga

SEQ ID NO: 392016 - DNA, 667 bp, Homo sapiens
atcactcaagtgatctggaatctaattctcacccagaactttaattgcatgaaaaactaagatatatagttgttagctttccagcatttgcatcttgcaagaaatgtcagaaatatattggagtggccagccgacattacgattgtgaaatcaatgaagaatcctccatctggtgttaaactagttatggctgctgtttgtgtcatgaaagatataaaaccagaaaaaatttcagatccttcagggactggaggcaagatattagattactggggacctagcaaaaaacttctgggagatatgaatttcttaagagatttgaaagaatatgacaaggacaacattccagtgactgttatgcagaagattcgtagtgaatacttaatgaaccctgaatttgatccccctaaggttgctaaagcttcttctgcagctgagggtctgtgtaagtggatcatggccatggaagtgtacgacagagttgcaaaggtagtggctcctaagaaagctcgcttatcagaagctcagaagtctttagctgagacaatggagcttttgaatcagaagagagcagaactggcagaagtagaacatcatctggaaaatttacaaatgacatttcttgagaaaacagaggaaaaggctgctttagaagaccaggtggaac

SEQ ID NO: 392017 - DNA, 555 bp, Homo sapiens
  misc_feature (16)..(16): n is a, c, g, or t
catctagacgatcccnttagacggtaccaacaccttcagcttggcattcaaggacctgtatcatgttagctgcattctcagctcccatgtcctgctgacagcatagcaagctgaacttctagctgctccctctgcaagccctactttctccaccttttggcctttaagcaatgggtttttcttctgcctagaattctcttctctctgtattcattcacaaaatcctgccagctaggctccagctagaacggcacctctctcataaggcctccctggtgcctctaattccatagatctcaacactgcctgtacctcagtgtcacctggggaacattttttaaaatgccaaggtccagacccaattcactctgaatctcagggatgagacccaggcagtggcaccttttaaaagtggtgattccactgcatggccagatttgaggaccaccagggctgggtggctccctcccacctcgtcatgtcatagcatgttgtattccctctgtgtcactcagccttgggttctaggagtatgtctcatgggccctgacagat

SEQ ID NO: 392018 - DNA, 243 bp, Homo sapiens
gttctgtacttttggaaaaatggggtcaaatctgatatgtgttcgtccgttcaccttttttctttacatgtttggttaatcacaatcagaaggtgaaaatgagaggttatttatagaactgaaccagtggtcccagctctttacagaagacacttggcatgttgcctgtcacttctcaggggtggccatggctgcttgagagtgagctccccaacacgtcatcacacacctacacctgtgcca

SEQ ID NO: 392019 - DNA, 459 bp, Homo sapiens
agactccttgctgcctcattctacatccttgacctactacttgctgtctagttttctcaatactggattgctcctactaattgcacttggatttttcacgtgaacccctaattcatctgtttcaactcaactatgaaactgctagaagaggttggtggacattccacatgaaaagatataaaattattaccttggagaatgcaaaataaacttattagagcactctcctccacacattgttcaagagctttggtgtatttctcaattcatagatcggttctgcttccaaaatccaggagaatgagaactggagaagtttttagtagatttttttttttttttttttttttaccagatcccactggtgctcaaggtagtcataaaagttacccctttatttcttagttcacaattcattcatttgggttttttgagacagcatctcactctgtcacctag

SEQ ID NO: 392020 - DNA, 760 bp, Homo sapiens
agcagggctggggaagaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtggtaagtcactttaggaagggagagacgtcgtcctgtttttcaggtagagttagcaaaggttcaatttaaaagaaaaattatctaagaagttaaaaatgaaagtgtgggggagattcccatgacatccatttttatctatttttccctttctcttacatttcccatgaggcaaactttctaaaacagtcttagtcttttcaagtttacaaaaggcagcgcccagactatctgaataaaatgacgggatgcccaggagaagagtgaacctctcccacgtgctccctgcctgggctccatgctgtcgcggggtctcggctactcactcagcgggcatttctggagttccaggaacacaaaccccaacaagatccaatcgacgccttcccggagtgcacagtccaggacgtaacccggagaacaagcggcaattaccccctgaggacatggcttcatctgtgcgacagacaccaagcgccttccccacgcccctgaccataaggccggcccttctgaagcgtggagccggcttggaacagagccaagacacacggacgcgatgcacacaggcgtcctgaccgagg

SEQ ID NO: 392021 - DNA, 540 bp, Homo sapiens
agaaaaagtataaagatgaaaaaaattatctgtataattttaccatctagaaataattactattaatttattgtatatacatctaggtatttttgtatgcataaaaacacagttttaaaatgtaaaaatggaatcctactatacataccatttaatagtgtcatttttttcttctttacaatgaatcatggatatttttgaatgctcacaggtatagattacattattattttgaatagctgcataaattccattatggctgtttcatatttttttaaacaattctcgtattgatgtgatcatttaagtttctaatttttcactcttagaaatgagactttatgaacatgtttgcatatatatctttgaatacctgtccagttatttcctagaataaattcctaggagtagaaatgctggagcagccgggcgcggtggctcacgcctgtaatcccagcactttgggaggctgaggcaggcggatcacgaggtcaggagatcgagaccatcctggctaacatggcgaaaccccgtctctac

SEQ ID NO: 392022 - DNA, 561 bp, Homo sapiens
attgaccagtcactgagtgccagatgcccctgagccagggacatgaccatgggcaagacggctttcttcagtagagtacaatcactaggaggaagtcctcagccacaagctgtcatctgtcaactttgccagcagctgggggtatcagtatatcagtccggaaggaggggaatctgggtgatatattacagcatccactatacctgagctgagagccatcacattctggtcttctcgacttatctcttaatacttcctttcttgctgtctgggctctagccacactgctttaaatttctttatgttctcaagtttcttccaaccttaggatctttgcacatactattcctattggtttatggccataccaatttaaacacctccaatcttatctagaaagtgagagcattttaaaaatcagtgtttaaatcgtatttgtaaagttgcttgaaaaaggactaggctattaggctagtgttaaagctgtcatttggagggcctttttagctttattataaattccaatattgggaattgctcatttgacatgatgtataggag

SEQ ID NO: 392023 - DNA, 673 bp, Homo sapiens
ggacgcgtgggctcagactgctgtgctagcaatcagcgagactccgtgggcgtaggaccctccgagccagagatgggatcttactacattgcccaggctgaagtgcagtggctattaacagctgtaatcataatgcattgcagctttgaattcctgggcttgagcgacctccccaccttagcctcctgagtagctgagactacaggaaataaacttaaggagaaagaagaaacaaagatggggcggaaatgtaagagaggcattctaatatatgcattcttcataacaactgtgtgaaacatattaatatcctcatgttaacgatgaagaaactaaatctcaggaagaaaaactaagtgaagacaaaagaaggatttgaactgaggttgtcagactctcgggaccatgctgttgaaaccactaaaccacgctgcctctgggtcacttgattattctgggagattctgggagtcttttctccaacactccagtggcatctgactatgtgagctgataagatctatagatctccccagcagttgttgaaaagcaagagcaggaaccgagagaaagccccttcttttagtcgaaaactcttactctgcttaggaaaaccatgaacccaaacagtgtgggtcagcctttcaatatgcaaaacggacgaaggtaccca

SEQ ID NO: 392024 - DNA, 431 bp, Homo sapiens
gaaggtggagagcaggagagcatggtgagagaggaagtcagggcagaggagtgaaaaggaagggtgatttcagaaccaccagggggcaagggctggagaggccaccagggcttctggatgggaacctggatgacagatgtacactatcagccccggtggtggagaacacaggagaaggaacaggagggcctgtcctcaatcccttgactctggtgggtcggccgggcccaacaggagtcctctagccgacattagcatcccagaagggctgccccagaccctacacccaaatctgtcatttggagcaagacatgagacatctttttgccttggccgggcatggtggctcacacctgtaatcccagcactttgggaggccgaggtgggaggatcatgaggtcaggagatccagatcatcctggctaacacgg

SEQ ID NO: 392025 - DNA, 444 bp, Homo sapiens
aatctaagagaatctaagtctgtggttcttcatgtccctagcctcaggaatctaattaaagctagagagcctacacctgctctgatcccccaacacacacaacacactgatgaacaaaatgttgcaaagagtattggggtttcattcacgcagtgaggcctgtgtatggattttaggataagaacccaggcttagggcattattactcctcaagcaatgttgcagagtattacacatagactatcctatatatttatgtttgttatatcaaagaaattatttcattattctaatactattttatcaattctttttcaaattttttattaaaaagttaataactctgtcaaaacaattatcagagttaaaatctcactgatttgaaactttagtatgttcttttttcctttttcttttgttatcatggagtaactagccaggtga

SEQ ID NO: 392026 - DNA, 228 bp, Homo sapiens
cgtctagaggatccctacgtctgaaagacatccttaaatgttgctccagcccatcgctttcccccatcaaaggacagaagcaggaggaaataaaaaaaaattaccaaaacccataaatatgacagaactcttatgaaaaggttacggtaattattcaccggggagggaaatgcttttcccattcattaatgcttcatttcttgtcttttctaatgagaagtaggtaga

SEQ ID NO: 392027 - DNA, 293 bp, Homo sapiens
ctaatcctttcttcacactgcccaccaaagtgacatttttgaaagtcagatgtaatcaagtaatgtttctgcttgaagctcgccaaagtttccccaatattcttggggtaaggtcaagttttcttaacaaaaccctttgtcctctattcccttctagctcctcttcccctattcaccatctcctctgcttcctgccccactctgagctccagccatgtggactctctgttctgttattctagtcctccaggctcctctcacctctggcttctgatcacatgcacacacgcccc

SEQ ID NO: 392028 - DNA, 787 bp, Homo sapiens
aagatggagaaggagagaagtggttgcaagagaatatttttaagtgttcttttttatcctgatgccacgttaatgtatgatgttagagttagttattcttagtagtctgttttcttttttgcactcaaaatgagaaagaggagataaggattgttatttctatattttagttagagaaactaaaacagtatacttaagtgacttgctcacttaagttacaagtaaatcttggactagaactaaagtctcacatcttgcccattgcctttttattattatcctgttgaacttgattactgggttggttttgagttaaatttgattacacttcccaaaaattgcatagcgttgtccatatcaccaaatatttattagatctgtgaatttacaaaagttcagaagcactctttttctctagaagcttatatttcagtaggaaaataagttgaccattgttagtaaacaaatagcattaagttgcatatgtagagatatgaaaagaatgaacaaatatcatttcagtgtatggggtctaaaaattaaagacatggttacagtaaaagcttcatcagagtcttttcaaaaacactgtaaaggcttggcagaggcattcaaaaggatggggagggttacataggtggagatgctcctgggctaggaagcagggtcagcaaagaatgaggcgaggcacagtggctcatgcctataatcccaacacctgggaggccaaggtggtcgggtcgcttgaggccaggagttctagaccagcctgggcaacacagtgata

SEQ ID NO: 392029 - DNA, 326 bp, Homo sapiens
ctcctgcctccctctccctgctgctcctcttcatgaagaaactactgggagagaagaagacaagctggaagaggccagggaaagggggttagtacaaagcacaatggggctgggctcatacagtggctcacacctgtaatcccagcactttgggagcccaaggccggtggatcacgagatcagcagatcgagaccatcctggctaacacggtgaaaccccgtctctactaaaaatacaaaaaagttagccaggcatggaggtgggcgcctgtagtcccagctactcgggaggctgaggaaggagaatggtgtgaacccgggaggca

SEQ ID NO: 392030 - DNA, 356 bp, Homo sapiens
cagtcggcacgaggttgatgagtaccatgctgggctggaccccatcctggctgccctggaagatagagacaggtcaccttgatccctgcctgtagcatttgggctggctgagatggtggaggtgtgaacagaatattccagtccagtgtcctctgtggtagggatggggatggacccgggagaggccctcctgttcctggcaggaggtgggactcagagttaaaagtgaggtcaaggcccagtgcgatggctcacacctgcagtcctagcacttcgcggagctgaggtggatcaccagaacccagtagttcaagaccagcctgggaaaaacatggtgagaccccacctctacaaaa

SEQ ID NO: 392031 - DNA, 399 bp, Homo sapiens
aggctccccgcagattctggcatttcctgcccctgggttctgaggcaggccctgtggtagactcaaaagagcacagggtttcagtcctgggcacaggcctggcccctgctggcttggccactactcagatttgcagcttggtaagttccttgacctgtgcacctcagtttccccccataccccttcctgttactgagatgattaaatgcctggttccttgcctggtgcaccctggaagctcaagtagatgtcgttctgtggcatctcttcttcctcctgccttgtgccctcatgttcatacatgcccctgccttgctgtctcctccctggtcggctgggttaggctctgacgcctgctctccctttcaccccagcaggagcatctctgaattcccttaa

SEQ ID NO: 392032 - DNA, 702 bp, Homo sapiens
tttggtgtggagaaataatatttgatcaaaacttaatagcatttaaaattgtctattggatctttattctaactagtgatatggatcacacaaaaggtgtttaggttctttcttccatggcatgagaatatttttaaaaatatatttggctactcaaaaagtacaatgatataaacagaatatggaaaatcaggagaaaaaacaggaattataattaatgacataacataaaccaaaaatgaagtgccaatctcaaatcattttttaaaatgtgtggtctgaaataatcaaaactgactctagaagaaatcattactaaaatatttgtcatacaaataattaatgagaaggttatcaaagaacttcatcaaagaattcctctaataaagtccctgggcccagaattcatagctcagaaaggaaaagaaagaatgcataatttccttaatgtataaatggattcaaaaccaaaacatgaaaaaactagaaattactcatacaaagctagcataaactaaaaaataagtgtacctgagtatgcttatgcacacgtatgagggcatatgtgtacgtgtgcacacctcacatgtgtatgcactacacacggggaatctatttacaaacataaatgcagtttatctagtaatatgaaaatgcagaaattaaatcaaccagtacttatctcagggatgtaggattttc

SEQ ID NO: 392033 - DNA, 461 bp, Homo sapiens
gcatgagccaacaggcccagccactgtgggcttttcataaatacactttgatatgctgagtttccttctattcctagttgagtgtttttatcatgaaagtatgctggatctatcaaatgctttttctgcatgaattgagatgatgatgcagtttttgtcccttattctgttaatgtggtattctctttactttgatgtgtttgaaattttccatgataaagtttgttttaagttacaacagtctgagaaacatagtcgggtgaagaaacagttaaccaaaccatatactgagcaaacttgcggccatttaaaataaaagtagatcagaagtaatttgttacattagagaattaaggggggaagtctacttatatttactaaacacatgatgtgcttgacactgtgctattccacttaaccactctgtgaggtaaatattgttattgctattttacaaacaa

SEQ ID NO: 392034 - DNA, 781 bp, Homo sapiens
tctcataatcccataacatgtgtgcagaattagaatctaataatctcatggaaaattgttagctgaaaaaaaatctaaagaaaaaatacactgtgattacaattgtgtaaagtacatacacacataagtacaggatacatggaaaaattattcttgtgttcaaatgacaagattatttctataacactgtctttactcttattttgccattcctgttaaaatgaattttaaatatgtcacaatttatgaagatgtaagtatgagcatatgaagcaaaactcgattgcagcctcaaggggctagtgactagccaggaacaaccttatcatttagctgcccacttgaccatctaaaagtatttcctgtgtgatttcctccaaagtccatatccggttatgctataattagaaaacccactgaaatttgaatgtgatttaaaatacttttttacaacactgcataggctactcttaaatcttcattgccattcccttattccttgttttttccccaatttcctatatttcttgttattctttcaagaaaaatttagaatccttactatgttcaaggcatgtcctacaatgatatataaagtattactgctgccatcatggaattaaaagaatttatagattgtgaaaccaaaggtacataggaactgtaagacaatttcaccctattggttcaaatcattttatgcatagtaagaaacaccaccatatttcaaagtaaagaaccgttcctataataaatgaattcagcaaattttcagaataca

SEQ ID NO: 392035 - DNA, 610 bp, Homo sapiens
cagggatggaattgatagaaaatactcagaaaggatgaactgaattttcttgtttaaaagcagttagaatttttttgaaagataagaaatagtgatatgggaactagatttcaaatgaataattagtattataaatggtaaaaaatttgatattagggaggctttccttaaaattggcattagtttttaaagcttgctttgttacaaatattattgtctttgttctctttcataatcagagcaaactaccttgtgagagaaatcctcggaaaagaaaataatgcaggttagagtgggttaagctagagtagggtaattttcatatatttctatattatagatttcactgtttttgtgttctcagttaagtaattttgggccagggatgtggacaaggaaatatatagatagaatacttgaataaactagggatgactgccatctatcatatatgtgactataaaattgttgtctttgaagcagtgtcaggaaagggaacatacacacccatatatatctgtggtgagctgtttagtggttaataaaaagactcctggaatttgtgattaggggctttctaatctatgagatactattagtgtgaagaagg

SEQ ID NO: 392036 - DNA, 701 bp, Homo sapiens
  misc_feature (485)..(485): n is a, c, g, or t
gcctagattgtcaccatcatttaaaaaaaaaatatatatatatgccctttactagtccttagtgcccagcaactatttcattagtaaatgccttatgtaagggatcagtactgctttcctttccccaccatctgttctgtatagccctccataatctggtgtctgtacatgtcacactatggaaactatgctcaggagagttatgaatgtctcctgatcaacaactgtattgtgttttgcagtttaaaggtacttcaaaagcttattgatgcttctgtttattttatcccatgcttattgtttttttctattgttaatagatgtttgtgaaaatagaaggagcactagttctagttcatgcttgcttttgcttttccatagcttctaaaactaacagtgaaaatgatatattgaaacagtaaattatagatctataccagatttgtaattgtgtatttcattgctatttgaagtataaagtaatnggttctgtatcatttattgggaaggttgaatttccatagcttcaaaatattcaaatttttttgcatggatttagctacgcttttcaaaatttccttttgatgaagtcattgactaaagcgtcattaaaacaaaacaaaaaaagaattccaaaaaccctccaaaattcctttttaaagataggaaggcatacctgctgtcattttataggtagaaca

SEQ ID NO: 392037 - DNA, 660 bp, Homo sapiens
catggtggctcacacctgtaatctcagccctttaagaagctgacgcaggaagatcactagaggccaggagttccagaccagcctgggcaacaaaagaagactcccaactctacaaaaaataaaaattaataatgtgattaaaagtaaaaataaaaagaggcagccatgaacaataaactatcagtgaataaagcaagagaggactgtctgcagaataaagagtgcaattgtaagataaaggaaaacgtgctgtttgagcagaagagaccaggagaaggtcagagtagctagatcatgcttgaggagaaaagatgggacttacaaagaatgtgttcagatgccatgtcctgtttaaaattaaattcccctgacaccacaacacctctctcctgtctggaaaagttaattaccttttttctaggctgtattttagatatgtttttgctaatgcagtcatcacactgcatggtaactatttgtttaaaagtctgatcctcagtaaactaagttcttacggctcaggggccatgtgttttggcagccctagtccataactcagcccaagaatgtgagataaatgaatgaataattttgttgcttactgcaaaaaggaaaaagacggttttgaagagtcagtgaaatatacatatgtatatgcaa

SEQ ID NO: 392038 - DNA, 363 bp, Homo sapiens
gaagaattgaagaacatatacttaagaaaaacagaggtgtacagtaaaggaattattgcaaaagggtgaagtagggtgtaagttaaatttcaggaagcttgagaaaagttgatgcactgttccagtggaacagaggcctcaatcttgcatcatcatgttttctaaatgttttaagggattgctctgtctttgggatgatgtgattatggcatgatgatgatattaatcacctgtaagtcctggtttctcaagtaaaggttaaaattagcgtctgtatgttaataacattagatataaaaccatatcgtgtgtatttttaattgtggtttggaacaaaataataaagctcttcatatttattct

SEQ ID NO: 392039 - DNA, 655 bp, Homo sapiens
gcaagagaagtgcagagcaaaggaggggagaagccccttataaaaccatcagatctcgtgagaactcactcactatcacgagaacaggatgagggaaactgcccccgtgattcaattatctccacctggcccctcccatgacacatggggactatgggaaccaaaattcaagaggaaatttgggtggggacacagccagaacatatcagttagaataggcaaaattcatgagctgtatttagaataaaagcagcactcagaaagtagagtgcacatgcgtgcgtgtgtgtgtgtgtgtgtgtgttagagaaggatgaagggcctaagagatatctaatattcatgaggtatttgggagctaactagacatgagattaaacatacaaacaacactaaatatacatgagtacttaatattcatgaggtcttaatttgaccatccactggtgacacccattcaggcaccaggtatcctctgcccagtaaaacaccaataaaacccagcaaaagattccacgtctagagttgcgaaaagaatagaaacggaaacaaggccgagttcttttggggatttggcccagactatattgccaggtatcctctgcctgtcgggcacggtggctcacacctgtaatcccagcactatgggacgcca

SEQ ID NO: 392040 - DNA, 330 bp, Homo sapiens
ggtttctctatgttggtcaggctggtctcgaactccccacctcaggtgatccgcccacctcagcttcccaaagtgctgggattacaggcatgagccatgcacccagctattctatgacttttaatggtcatcatcctctatgtttgtacaaagcatcttggatacaatgagtcatgacattcttttaacacccagtgttgggcagaaccatggtgtatcattggactaggccagaaatttgtaaattctctcttcgcaaaacactgtgattgaaccaggatgcaggccaggatggagaaggccatctcatctattgtcaaaaggcccacc

SEQ ID NO: 392041 - DNA, 371 bp, Homo sapiens
tatctcagtcagctgagcgtcttctcttgtatttaagagccatttgcctttgcccttctctgggccagtttgttcatttccactgcccatttttttctggcttgtttttttcttattgatttgtaaggccctttatatgtgagaggtattcgtcttttgtgatatgagctgcatttcttttaactccagttgaatttttgagtcttagtttctccaatccgggttataagggattttcctgtgctttatctagtatcatcacggtttctctcacttgcatttttttgtttgacccatttgcagtccaccccagtgtgctgtgctatggggatccaaaggtgttttccccccgcccagtagcagaaaaatcc

SEQ ID NO: 392042 - DNA, 418 bp, Homo sapiens
cgaggagccttgcctcccacagaaagagccggccactgacgtgttcacagcccctaattccagggccgccgagaacggcgcccccgacccgccagagccggagccagataccgcgctgctccaggcccggtccaccgcggagtgctggcccgaaggcggctccgtgcctgcctgcctgcctctcttccgaggccagacggtccctgccagttcccagccatcgagccacagcttccagtggctccggaacctgccgggctgtcccaaaagcaaaggcaacaacgtgtttgttgtccacaagccctcggccgtgccctcgcgggagggctccgagtctggcccgggacccagcagcggaagcccctcggaggagtccccgcccggccccggcggtggcctggaggatgctctgcccttc

SEQ ID NO: 392043 - DNA, 460 bp, Homo sapiens
tctagagtaaggttttagccacattaggaggtaaaaaccaatgtcagtctaaatcaaagaaaaagtcaccaatgagtaatcagcttctttaaagaaagtgtgaagaaagggcaattacaggaacagctgtatgaaatggttccattgttatgtaatttaactgccaaaaatgatgtcaagtatccaggaaaaacccatctatgttcacattttagaaacttggggctgggtgaggtggctcatgcctgtaataccagcactttgggaggctgaggcagggagcagggggccacctgcggtcaggagttcaagaccagcttggccatcatcgtgaaaccccgtctctactaaaaatacaaaaaattagctgggcatggtagcaggcgcctgtaatcccagctatttgggagactgaggcaggagaatcgcttgaacccaggaggctgaggttgcagtgaac

SEQ ID NO: 392044 - DNA, 385 bp, Homo sapiens
tcctcaagaaaaagtcacatgatatctcttactaggcaattacaggaacagctgtatgaaatggttccattgttatgtaatttaactgccaaaaatgatgtcaagtatccaggaaaaacccatctatgttcacattttagaaacttggggctgggtgaggtggctcatgcctgtaataccagcactttgggaggctgaggcagggagcagggggccacctgcggtcaggagttcaagaccagcttggccatcatcgtgaaaccccgtctctactaaaaatacaaaaaattagctgggcatggtagcaggcgcctgtaatcccagctatttgggagactgaggcaggagaatcgcttgaacccaggaggctgaggttgcagtgaac

SEQ ID NO: 392045 - DNA, 346 bp, Homo sapiens
actgtttgcacctcctttagatggtcatgaatctgcattcacatcagtatcactttgctgatattcacttgcctggaccctacaaacctgtactgtgcgatacagtagacactagccacatatggccatttaactgagttaaaaatttcattcctcagatgcaccagtcacatttcaaatgctcagtagccacatgtaggggctaccttattggacagtgcagacatgaacatttttatcattgtagaaaggtctgttgtatggtgcttctttagacgtttgagtttgccacctctgttatacagaagtttttaggtagcatttattattatttttaaatttgtat

SEQ ID NO: 392046 - DNA, 634 bp, Homo sapiens
tgatgctgctggagctatgcctgatgcctctatgtatgttttattcatctactggatgacctgcaagaatgcctgataggcactcttggaacgttttacctctcggattaagaaacacctgtgttttcctaataaaaacttctgtttctttttagaaagaggcttctacctaattcagcaaaaccatacttgtatttatgggaacgtttaagacctttattgtcagaaagtagccctaaaaagacttcaccaaatatgcgcatgaaaagatgctctattagagaaatgcaaagtaaacttattacaggataccacaacagagttattagaatggcttgaattaaagactgaccatactaagtgttagcaagtttgtaagttctaatgtatagaactctcatacactgccggtgggaatgtaaaaatggtacaatcactctggaaaacattttggcagtttttaaaaaattaaaaatacttctatcatgtgatccagccattccactgctaggtatctacccaagcaaaaagaaaatgtgtatctatacaaagatttgtacatgaatgttaataacagcttttttgtaacagcagaactcagaaatacccaagtattcatcaagaggtgaatatg

SEQ ID NO: 392047 - DNA, 428 bp, Homo sapiens
ggtggtttgttgagcctctctgctctgtgtcctggcttggtcatttgttgggaaactctcaatttcaacaactgtagtaggtcttttctcttaggctggtcagatactccacaactcttccaatttccttctgagagaagttcgagggtgggcaatgaagagatggatgacaacactccatatgcgttcattcctacaatccctatcttcaacacagaaatgtggctctcgctaggcgtggtggcttacacctgtaatctcagcactttgggaggctgacttgggcagatcacctgaggtagggagtttgagaccagcctgaccaacatggagcaatcccgtctctactaaaaatacaaaatcagccgggcgaagtggcacatgcctgtaatcccagctacttaggaggctgaggcaggagaattgtt

SEQ ID NO: 392048 - DNA, 269 bp, Homo sapiens
catgttcaaattttccctttttatagggctaccagttatatttgattaggtcccattcaaatgacctcatttttatgtgcttagctctggaaagaccctaattccaaataaggtcacattctgaggtactgggggttaggatttaggcacatcttttcttcggggatacaattcaatgcataacattgctgttaaccacgtttagaacatgcagtcactcagaccctttctactgcatacagaccctttttttttttttttttttttta

SEQ ID NO: 392049 - DNA, 256 bp, Homo sapiens
acatacagatggggcagctgaggcccggaggaggaagtgacttgctcaagttcacatggccatctagtgtcagaggcagaagaaaagcccacaactgccaggccttcagcttcttcactcctttcttcagacttcaaatggaaaatcgcatcccagagaggtgcctctgctaggggtgtgaagagctgagaaggaagcaaggccaagggagtcttccctgccctcccctcaacaccttcaggggctccttccagct

SEQ ID NO: 392050 - DNA, 296 bp, Homo sapiens
taagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcttgtctcagcctcccaaatagctgtgtctacagccacgcaccaccacacccagctaatttttgtatttttagtagagacggggtttcgccatgttggtcaggctggtcttgaactcctga

SEQ ID NO: 392051 - DNA, 225 bp, Homo sapiens
gctagtcaaaactcatgctctgggttgatttaagggcttcccccagaggaaaaagagcccttcagttgcaatcaaaggtatccttacagatattctacacaggaatgcagcaaatctatgaccttagcctaaaccaagctgtgctctagcttcttaagttaatttgggttgcatatctcaaaagacatccttaaaggttggcaaggaaaagaatatcaaaagaga

SEQ ID NO: 392052 - DNA, 644 bp, Homo sapiens
gaatggggaaggacaaagcatccttcttttatgcttccttaattctcttttctggtcttctcacttctaaaccaggatctgctttgtattttattggtggaaaaggaaagaaaaatataaatcagctttgtcatttcaacctctgattataattcaaccctggaatttagtaatttgtactctggtactttcagcttagctgcctgacagagcagaagggcaatccagtggtcccagggactgggaacagtcacgttcctttagtatcctgttgttacctatgccgcttcctggatggtactgtgggctcactggttcctagccaaacctttcttccttgaattgatggccccacagttaaagggctatgtaaaaccaaatactttagaaacattcagttttatatagctgttgtgccaatatataacctttccatttctccacttgcctgtctctattctgataggggcattatttttcctgccctcatcctcttcaacctcagtgctgtcctggggtataaacatgcatcatttaactatgatttaaatatgattcgttatgtaagatatgtgaaaatcagtcccaataccatagtcaagatgtatctgtgtcagtaattacaaacaccactttgttattca

SEQ ID NO: 392053 - DNA, 140 bp, Homo sapiens
tctctattacaaaacaatgttttttgtctttataccttttgataccatctaatgttatattatgcatttgtttatttttattatctgtctctcctcttttaaaatataagcaccacaaggtctttgattggttcactgct

SEQ ID NO: 392054 - DNA, 161 bp, Homo sapiens
aggtttattgctaattatacccatgaatgaattctgaaaatgtgtagataaggaatttacctggtgaacggtttacacatggcaattgtgggagggagaggggagtgagaggagatgagatcagttttagctttaagaggaccaaccgggccaagcacggt

SEQ ID NO: 392055 - DNA, 312 bp, Homo sapiens
  misc_feature (230)..(230): n is a, c, g, or t
  misc_feature (257)..(257): n is a, c, g, or t
  misc_feature (265)..(265): n is a, c, g, or t
  misc_feature (283)..(283): n is a, c, g, or t
ccctttgcctctggaaatgcaggctgcttccagggcatccccctctcctctgatggctactggagttctctcaggcaccttctcacctcgggactattccacaatgtgttcagagcccagttctccagaggagcatgccaaactctgcaagcatgtctcttgcagtggccctcatttggcctgagtatagaggaactcctccatcctcagggtgagctctgacaactctnccaaggccgttcttggtatggtcgttncttgtctnctccgccttccatggganccactgggggccgaagggcaccatttggg

SEQ ID NO: 392056 - DNA, 385 bp, Homo sapiens
tgctatactgtggagatatacacagctttgaggacaaggaatgggtaaacatgactgttgctactccttatagccagttctgcataattatttataagcatttcataacttactgattcagaagtaaatcagcaccacgtattgttttgcacccagcaagcttagctattctgtatccatccttgagaaagtagtctgatgactctaagatatgtctctgctgctgatgagcagttcaaagctttccctttaagggagaacatgtgttgacttacagaagaaccccgcttgctccaacataactgcagaggtctgtctcaaatccctcctattcatgatctcccctgatatactctctctttctcctaacgtgtgttagagagag

SEQ ID NO: 392057 - DNA, 560 bp, Homo sapiens
ttaaaactttctacttggggttgcttctaaatagcgtgcatggcaaaggccttgggagcacctttcacgaagcttaatattttcataagcaaagaaaaggacctagtccgtgactgcgtatgagtcacgttagtttggttttcttcaaaggctgactactccagttgctatctctgtgtgacacagtgtcttaggatgactatgttattttgctcatgatttcatagatcaggaattcaagaagggattagctgagtggttcttgccgggggtctcttatttgttgcagtgagatgttggctgagcctggagtcatctgcaggcttggctgggctgcacgtcccagatgatcctctcacatgactgatggtcactggttatctgctgagttctcagcagagatgccagagcacctacacgtggcaatctcagggcatctaatgtcttaaacggtggctgacttctcccagagggagtgtccctaaatacttggcagaagccgcacggccttttctgatccaacctcaaaaattaaggcatcactattgctggactgattg

SEQ ID NO: 392058 - DNA, 389 bp, Homo sapiens
cctgtcagcactacatgctaggctaatgttttgtatttgtttaagagatgcagtttccctaagtagcttaggctacttttgaactcttagactcaaataatctgcctgcattggtctccccaagtgctggaattacaggccatctaaatcttttatctcagatttgccttgtggcaaaaggtggggtacttattctgacatgatgaggcggagaaagatgaggtgggtgcatcctgtgcatattattatcttaagagtgactgggaagatgcttgaagaatattcttttgtcgactctcatttaaggagcgttgaatttagcatgcattcaaaacctaaacttctgctgactgctgggtaacaatcagatgtggtttcttggtattttc

SEQ ID NO: 392059 - DNA, 303 bp, Homo sapiens
agcagtcactggggacatgggcactatctagaatatgagggctggagaagatgcaaccttggccaggggagtgacgtggggctcttgaggtacataatgattttgactgctgttatcaacctaaaagcactttttaagctctcgctgtaggcaacctcattaaggcctgtgcaggcaggcagaagagatatatgtgacataagtccaacgagaaagccaacattctcagacaatccacgctgagaattacaggaggggttacactcagtgcagagaaaagagaggtcctgggggctacagaac

SEQ ID NO: 392060 - DNA, 440 bp, Homo sapiens
ggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgtttttttttttttttttttttggaaaaagagtctcacccgggggcccgggcataaagtgcaggggacggacctgggcatcagggaaatctacgggccgggggggcccacaaaa

SEQ ID NO: 392061 - DNA, 450 bp, Homo sapiens
gatgccttggcatcccaaagcactgggatgacaggcgggagccaccatgcctggcctatgactatttttaacagatgataaaacagcagaagctaaatagcgtgcttagagaagcttggggggccaccagcagtagggggctgagcctcactgagccttgtcttcctgctgcattccacaccccagcctcctccactgggtgcctcctggagctcaagggaacacaaggtgctctggccccttactcctgtgggaggtgggacactgaatgctgaagcaggagcaccaggaacattcagggatgcctggtggtctttctgacttgagagcacaggaggtagaagagcttgtaggtcagtcatcccttggtgggcaccctccactgagttacctcagggcaacctcctggcagcttctgcccaccaggccatgctcccctggggcagttgt

SEQ ID NO: 392062 - DNA, 316 bp, Homo sapiens
gggggtgagattatttcccgcatcgaggggggcctccgcctccctgcgatgtgggtcctaatatccagggggggagagggggcttatattactcaccgcatctcggtgggcaccctcgcccccctgcgatgtggatcgtaatatccagggtgggagaggggggcgatattactgcccgcatcgtggggggttattaataccttactcctgggagattttctctactgccacacttggttgacaccctgggacattattttccgtattttgggaagatgcgactgttaaaatcacaggagggatacaccctgcgatg

SEQ ID NO: 392063 - DNA, 148 bp, Homo sapiens
actagaatcaagaacttgaggcctggtttctacttgacctacctgcctgtgaatctcctttagggtcttcaggatcttcagaagtgccagcctcctcaggaagcaatctagaggggaagagattaaaaggcggcagacatatacacca

SEQ ID NO: 392064 - DNA, 390 bp, Homo sapiens
ccgcccgccctgcaacaggccctggtgggtgatgttcccctcctgtgtccatgtgttctcattgttcagctcccacttatgagcttttcttttagtcctttaaatgaaatgaattaaaacattaaatataaaatatgctattaatttgataagcgcatgggattcttagccctttaaaagacaagaataaattgcagatgaccttggctagtaagaaaaatgtcttcaaaaagtgatactgctccacaccttcaaccatcaaattaccctttacacttaacatgtgagaccccaaggatgagcaaacttccacagaggagagagtgagttataactgttttaaacatgtggtcagagcaccctcaggtatttggggaggggattcagggg

SEQ ID NO: 392065 - DNA, 335 bp, Homo sapiens
atagcctccaaaatggcctactccgcattctctctccctactacgaaagccttcatacaaattttcaagtcttcctagatcactttgagcttcataatggggatatgaagagcatgggcaagacacgatagataccatgctgtgaatacgagcaactgaatgtgactattgcacacatggggaagaaaaaaggagaactgccaggcacgatggacacagtctctcagataatgagtcagcaggatgatgaattcgcgcagcaggatgatgaagtcgcgcagcaggatgatgaaagcaggatgatgaattcgcgcagcaggatgatgaattcgcgc

SEQ ID NO: 392066 - DNA, 799 bp, Homo sapiens
ggcaatcccatcatattctagttgttagaagcaggttaataagtacagcctatacttaaggagaggagaattaggcttcacttttttgaaaagagatgaatcgaaaagttttggacatagtttaaaacaatcatcatctccaaagtattattttcctccagtctctttgtatttccattcagtctatatgttgcaagaattatccttctgaaatgcgtatcttcagtcattctctcatttaatgcatttcaccagttcagtgaagtgtgaagttcatgtttctcaaacaaagctaaagatacaagctttttaaagatctgtgtactgcctgtctaatctcgtagactcgttttcagttatatttcagttatgcccagctgcttgtccataacagttaggaccttttttcttctccccagacagtgtaactcaaattgactaccttttcaaagccactaagtctaatgcatttgaataagcgaattggatgcatcaggactgtctgtgttattaacatcacagtaggtaactgtggtagacagaattatggcctcccaaagatatctatatcctaatcaacaaaacctgtgaattttaccttagatagtgagagagactttccagatatgcttaagttaaggactttgaccctggtggacccagtgttatcacagggtccttagaagtagaacaggaaaaggctgggcacggtggctcatgcctgtaatcccagcactttgggaagccgaggtgagcgaatcccaaggtcaggagatcgagaccatcctggctaacacgg

SEQ ID NO: 392067 - DNA, 460 bp, Homo sapiens
aagggtccccatttatgcaagatgtgatgtaaaggacacccccagcacatagccctcacagaagagttgagatgggaaaggctaattgcaagttcttcattcagtcacccaacacatatgttgtcagcaaactattaaatggtgattattgtgcctgggaactggggatactgatatgaatgacacagcttgccaagggccatgaatggatacaattcctgtgctagtggactcccttaatagtgtagggaagagatcactagagcccttcagaaaccatcaggggctctgcacagcgtcagtgttccaggccctccatttgtcctctccacttcacacccccatctgtcttcatccattagcctccggaaatctgtgttactcaatgtacctataatgtacctcaggcttttcctgccctgacctttgcttcatctggaatcatagattgcaaaaatcc

SEQ ID NO: 392068 - DNA, 267 bp, Homo sapiens
acagcccagcaccagaactccagccacatttttacaaaaatgctaatgtttctattacccttacactgagaaggtgggagacacctcttttaaattaacagaacaaaatagctgtgaactttaataaagtgttcagtcatgacatctaaatagtacctatgatttcagaaactgaaagccactctaatttcagcaatttcatacatgatgactaaatcatttcattttttcaatatttaacagaaatcaataaagcctatcatctat

SEQ ID NO: 392069 - DNA, 353 bp, Homo sapiens
tgatggtacagggagaagacggccatctacaagccaaggagagaggcctcagaagaaaccaatgctgccaacaccttcatcttagacttctagcctccagaactgtgagaaaatagatttcttttgtttaagccacccagtctgtggtgctttgttatgggagccttataaactaatatacttactaagcaaacaatattagctactataactattatcattattggccaggtgtggtggctcacgtctgtaatcctagcactttgggaggccaaggtgggtggatcacctaaggtcaggagttcgagaccagactggccaacatggcgaaaccccgtctctactaaaaatac

SEQ ID NO: 392070 - DNA, 183 bp, Homo sapiens
atgtgccaggcatgatagaggcctggactgagtagcgactctttggtatgaaccagatataacttgcacgatgtttcacaagctggtttggatgttattagcttagtgtgtcatttaccccatccctactcacacccgaaacatgatattttgtggagctaaaaaaaaatacctcaaacaaat

SEQ ID NO: 392071 - DNA, 1050 bp, Homo sapiens
gtcttctgcttcaaacaactaccccaaatttgctagttttatacatattagcttaaaaacaagagaagccaaagattaagtaagtgaattgtgttaaagattgcctgaaaacatttgctaaggggagaataaaactaaaactgtggagtataaaggatgttggaattaaacatttttaagtactttttcttttgcatctgatcgactgaagttattataaagaaggaatcaagtatgtaactttaaattctaggtaaacatccaaattactttctaaattcatttccaaaattctcctgtgctggcagttagctactagagatcatcatttgattttgtagtttgccatgttctgagtgagttcagctgcttactactacccatgtcattgtgtttgtattgattgcctggctcagttatctcatgttcttcatgaactatatacacattttcattgtctttaaacaatactgagttttgaagttaagtagaatattgtaggggttatcagaaacccatattcattgtggtatgtttctgtctgatactttaatattggtaaatatagtttttgacattgcattttacaatcctattgttttttagagtgatgaaagttcaagttttaagagaagtggttgcctttctcatactgtcaaacatatttcttctttattatactctggtgctttatccttctccataattctctattattacttattttaaatgttttccctatcacattgaaaaacttaaatgtccgttctccatttgaaaatatgccaaaagtatgatcccatgtaaatatgcagaaacgattgctatgaaaatgtcagcatagtttaaatgtattactctgatgattacagagatttcttcaagttgttcgtgttaagatgcatcttaaacatgatctcagttccttaaaaaatgataaaaatttttcatgtatattacatatctacctaccagaaatcctttttacaattttatatacaatcattttaagacctttttgaaataaataatgcaaatgaactaaaataa

SEQ ID NO: 392072 - DNA, 128 bp, Homo sapiens
gagtgtggtgaacaagaggagctgatgacctcaggcagggaccttcctttctctgggtctgtcccgcaacatacacacacgcacacacgcacacggacatacctgtgcacacatgtatacacaagaca

SEQ ID NO: 392073 - DNA, 327 bp, Homo sapiens
  misc_feature (149)..(149): n is a, c, g, or t
tctgcccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctgnattcaagtgattctcctgcctgagcctcccaagtacctgggattacaggagctcccaccaagcctggctaagttttgtattgccatattgaatttttgtttagaaaagatatgtgtttatgtttccagttttattacctttcactatttataataaaggaattctttatgctttatgt

SEQ ID NO: 392074 - DNA, 335 bp, Homo sapiens
cggattttgcccctcacaaacttgttttactactagctagccttattactttagtcacttaacctttttgcgtcttagtttctcactaatccagtgactcttgcccattttatagattcagatgttggaagcatgatacaatacttgtttatcccctagtggatgttcactatattatgctttattacttttatcaatgttgtattttcttttgtaaggatatttcattttttaaaaaaaccaggcaaatataaacaaaaacaaagcatgagtttttaccatcaaattaagctgaactctagactcaaagcaataaacaagacaaaaaaataaca

SEQ ID NO: 392075 - DNA, 476 bp, Homo sapiens
aattttctccttttctgcaacctgggaaactaaagctcagagatccgcatactgtgctacccaaagaatataggaagagaacccgactttttaccttttattgattaaaaaatgagacgtgtcctcacaatttccatgtgattaaccagtcctaaaattataagacatcctttcctcacttaattacatgtagtgttgttgcgggacttttccttagttcagctgaagatggggttcttgtcacagggcattgaaaatttaggctcgcagacaatttaaagggtgactaaggcagggttttattgggtgaaaaggaagacaaggggaaagggagactatcagcaaggcgaaagagtgtgcttcttgcccctgggcttcctgccttgcagattgaatcccaggtttcacccagaaagaggaggggccaggctcctccctgcagacttctgtggctccaccccagtgtgcaggcctgt

SEQ ID NO: 392076 - DNA, 219 bp, Homo sapiens
aagggattcctgctagtttctagtgagtggtagaggcagaagtagaaaagagctctggcttttgattcaaggattaatgtccctttcactcttatcgtgttgcttcttgaactgttacttatcctcaaagtccagctcaaatgcagccttttctgtccccagcccttcacattgaaatcaattattttcttttctgtgagaggtgaatagcactatata

SEQ ID NO: 392077 - DNA, 433 bp, Homo sapiens
cccttcttgtctttagcactgtgcagatcacacgtggaatgtagaccctgcccctggatgcgtctgaggggctccccatacctcatagtctctcctctggctctcctctctctcctggggcttgtcccagcacctctgggtaacgtgttgagaccttcaaatctagagcaaaacaactttgactctgcaccattcccggttcaaatcctggtgctagcctgcttgtgggtgtctcttggccactgcttctgctgtcagagtgcctcttcctcttggcctctagcccacgtcttacctgtctgtccactcagctggcccctttgtgaaagcttcccatgtccccctggcctcaggcatcctgcccttcctcccacagtgtgtggctcgcccctcctggcacatctcacggtctcacctgtgtgggagcctctgc

SEQ ID NO: 392078 - DNA, 551 bp, Homo sapiens
agacaggttggatttggattgccagcaggaaatgcctagcagacatccggaaatgtaggcctagagttggctcaagaggtcagggttgaagatggggtttgaggagtcactgctgagggatatcaatttagtcatcatggcaagcaagactgctagagagaaagtgtagacagaggaaggcagaagcagagagattcatggggagatgctcacacgtagaagccaggaagaaatcagtggtggagaggccaggagggagcaaaacagtcgatggggaaaagtaagaggagaattttcttagaagaatagggtgagtcaacaagtagcaaacactgaataaagaagtaaaaaagttttgcttaaatctagccatgcctgactgcagaagtgagcacaatatgcttctgaaatgattaccctcccaaaggtagaggagccaggccaggtttctgcaatctcagcacagattaagcaggcaacgctgggagttctgagcttccactcaaagtcagggaaatggcaagtatgggatcgctaacccactccacccc

SEQ ID NO: 392079 - DNA, 331 bp, Homo sapiens
ggatcctcggagttcccttagtctagctcgacattttgtctgatttttagttaagatgtcgctctgtcccctaaactggagtgcaaaattcttagggtcaggattcttattggcccagctaggtcaggtgccaacccttaaatcaattgtaggcagagatgtcagcttttatgggattataggcatgagccaccacacctggcctaatttttaaattttcgtagagagaagttctcactatattgctcaggcttacctttatcttaaagtaatgagaaatcattgagggattttaagcaatgatgtggtttgattagacatatgttttaga

SEQ ID NO: 392080 - DNA, 163 bp, Homo sapiens
tctcttgggtgtagacctgcttgtggagttgctgggtcacgtgataattctgactttttaaggaactgccagactctttccacagcagctgcatgtaaccgtcctggtgggtgtgcagtggtatctcctggtggctttgaattgcatttccctgatgagtaat

SEQ ID NO: 392081 - DNA, 608 bp, Homo sapiens
tagtagtccattttcacactgctgataaaggcatacccaagactgggcaatttacaaaataaagaagattagtggacttacagttccacatggctggcgaggcctcacaatcttggaggaaggtgaaaggcacatcacaaatggtggtagacacaagaagagagcttttgcagagaaactccctttttaaaaccatcagatctcatgagatttattcactatcatgataacagcatgagaaagacctgtccccatgattcaattacctcccactgggtccctcccagaacacgtgggaattaaagatgagatttggttggggacacagccccaaaccatatccagagtgaaaaggcaacacttgggagaaaagattcacaaattacatacctgaaaagggttaatattcaaaatatataaagaactcctacaactcaacaacaacaaaaaactaatgttaaaaaataggcacaggacatgaatagatatttctccaaagaagatataccaatgtccaacaagcatatgaaaagatgctcaacatctccaatcattagagaaatgcagagcaaaactgtaatgaggcttatgcccatgagtggtcactg

SEQ ID NO: 392082 - DNA, 194 bp, Homo sapiens
cttttgcagtgacctttattctccagttaacttatatgtaaagagcaccttgtttaaaatctacagattttgtgatagcgtcagaaccgaggagacggcatacttatttaattactgacttgttgcatacttctttgtagatgattttaccatttgatgccctcattttcccattggcgaagttaggatttgtt

SEQ ID NO: 392083 - DNA, 117 bp, Homo sapiens
ggaggaagtgagatctgccagtcgttttaaatgctgtagtgagaactgtcatcacttttgacatgttcttctttttttttaaatctcccttgctcagttatagcaagtccccacttt

SEQ ID NO: 392084 - DNA, 153 bp, Homo sapiens
tgtggcccatccaacaaaccaattatactatgtatacaacctatgtatagtatactatgtatagtataaaataagtcttgtgacttttttccataaagttaaatctgaaagaaaactgagaagatatagaaatatcaaaatgcaaatgtaata

SEQ ID NO: 392085 - DNA, 399 bp, Homo sapiens
ggagggatagcattaagagaaatacctaatgtaaatgacgagttaatgggtgcagcaaaccaacacagcacatgtatacatatgtaacaaacctgaacattgtgcacatgtaccctagaacttaaagtataataaaaaaaagagtaaacattttttgatgtttcgataatgtaagtctgtgccaagcactattttaagcattttaaataatttaagtaatttaatctttttaaatttttttttttttagacggagtctcgctctgtcaccaggctggagtgcagtggcaccatctcggctcactgcaacctccgcttccccggttcaagtgattctcctgcctcagcctcccgagtagctgggactacaggagcatgccaccacaccggctaatttttt

SEQ ID NO: 392086 - DNA, 694 bp, Homo sapiens
taaccagtgttggagaatcacaaatgtgttatgcactatccattacatgttgatataagacaaccgagctcactggttgccgcacataatacccatagcagcacaagatgcaagtcttacccccaaatgcttacccggaatgagcagaattgtcttactcatcctgattttacccaaaatctcatgaatgggcttgctgttgagcgtggtcacacaaggtatagtttgtacaagtaaagaaatgtgaattagtagctatttatttccttagtagcaggtaggactacttagcttgttacaacagctttgatacacagtaagaaaactctactgacagattacaagcagccaaatgtgtttacatttcagagaagggtaagggaagcctctcgttgtcttcatactttggaatgtcttaagctaaaatgtgacactagagttcaatttcttttttattttaaatgtcactaaattgtaggtaaactgtaccaaaaagttctagtttaattttaacagtaaaaactcagcataccatgttaccacgtaaacaataatggctggtattttctgtgggttaatttaacatgacataaacataggaaagcccttggcaaaattctacatcattgaagtagaccatttctaaatgcaattaaatagtgaggttattataaaaattagaatttaaaatatg

SEQ ID NO: 392087 - DNA, 798 bp, Homo sapiens
ggtgggtgcgaggcaagaggaggctgcaatgaattgagattgtaccactgcactccagcctgggtgataaagcaagacactgtctcaaaaaagagtgtgaaataccagacatttttagttaaggaaaaactaagagaattcgttgctggttggtactgtaacaaacaccaatggaagttccttaggctgaaaggaactgataccagttattttcaggcatagaaatcacaattgaaacagaatgaagcactgcctcttaatgaaatcatcaataaattaggaaatgagtggataaacattatccacttaatgtccctttcctccaacgtcatcacttctaaatcacagaactttagaaatgaagagcatggacactacaaagaaacaaaccagaaccttacaggttggcctgacatactcaagatacaacagctggtggcagaaagcaccaccaggattggagtatagcattccttgcttctgcacctgtctttccaggtgttaggtcatttgattttaataaatggtataaaagttaatgtgaattttcttgcaacttatgttgctatgtgatggctcatcaaaagaagcataaagaaaaactaaaatggcagagaaaaacattacttataataaaatatttgtgtttttactactatatctgagacccccagcaaaagcaatagaaataagaaatgggaggtataaggaataatcaaaatagtgattatctgtagacattaaaacattaaaaaaaatcagtaagacaccaagaagaaaaagcaaccaaaattattt

SEQ ID NO: 392088 - DNA, 718 bp, Homo sapiens
ttaagctcacagaagcaggactattagagagagaatagggacctcatccagattgaaggacagaagaaactcaaaggaagaacatcttagaggatggagtcaagaattttggaaaactggacaagagaacccttccaagacataagaactgcaatttaatacgggaacattctctgtgcctaagctctagaggctgcctgtgtttcttgtcttgtggccccatttcactctgacctctgcttccattgtcacatggccttctctgccctgaccctcctctctgcttttaaggactcttgtgagtacaccgggcctgcccaagtaatgtagaggaatcctctgatctgaagatccttaactaaatcacacctgtaaagtcccttttgccatgtaaggaaacatttggaggtctgggaattaggacatggacatctttgggacaccagtattcagtctactacaagctttaagaaatgtttattttcagttatttacagtataaagtggtatgcagttatcaataagataaacaatgacatgtcattatttggattttcctctctgacatcagactaatgaccattatcttagtaacttccaacaatagggtaatttctataatagtgaatctgacttttggttaaaacaatatcataaagttgtatggtagagcaaatgattgggtgatgagattacatatgattccaggactccttgg

SEQ ID NO: 392089 - DNA, 626 bp, Homo sapiens
agcggacagagagacaaggatgtctgtctttggcagccagattgaaggacagaagaaactcaaaggaagaacatcttagaggatggagtcaagaattttggaaaactggacaagagaacccttccaagacataagaactgcaatttaatacgggaacattctctgtgcctaagagatcaaaagttgaagtgcctatagggacccaggctaagaaataagaagaaatgaaaactgggctagaccaaggagtacatacactgccccaccaagaaggttccagagctgcttagctccagccaactattgccacgggggacagtgcaaccacatgttctaggtgttcagtagaacttcaaacatcaaaaaattactggccaggtgtggtgaaaacctgcagaagactgacagtaatgaaagtggcttgagaaaaagtgaggatatttgcagattgaaaaaagaaaaacaacttcctatttgggggaaaatctcagtgatgaaaaaaattgtctcaggaggatttcccagcatcataatcttcctgaacactgaattctctagttaactacagaaatcatgtgttacataaagataagatggtcaaggaaggaaaagatcttacaatatat

SEQ ID NO: 392090 - DNA, 804 bp, Homo sapiens
aagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccctgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaacc

SEQ ID NO: 392091 - DNA, 336 bp, Homo sapiens
aaacatactgatatggcagaatagaagagagcactgaaaatggatccacatatgtgggaacttgatgtttcttaaaggtggtatcataaactaatagaaatagggaccactgaatacatgataaattagtttatccacagggaaaaagataaaacagacactatttgaaactttaccccaaaagactaaatatgaaaagtaaaatggtaaagcttttagaaacaagttacaacaagttatagaagagtatctgtatgatatagtggtaatgaaggatatatttgttttaaaaactcacaaaaaacagatgccatcagtaaaaaattaatagaactt

SEQ ID NO: 392092 - DNA, 302 bp, Homo sapiens
attttgtataagcatgtctctaatgcatataataatttactgggaatataggcttgcttttaggaatttactttataaacaatttggaggaatgcatatctttctggtaaattcagagaaagacgaatggaataattgaagaatgatgacattccttgggtatagtttttatttcattaaactataccttcgatatagtttaataatcagtaatactagtcaaaaacactagctagaaactctgcttctgttcctttgtcaatataattattatacaaggatgagatactatgttataaata

SEQ ID NO: 392093 - DNA, 759 bp, Homo sapiens
cacattctaaaaattaacctaatattaaagctatagaacaaaagatgaacctctccttccccatgtctaggaggattaattcttttccagactttgatcatgttttttatcaatttaaacccctttcacaagctttgtattatccttaagatagtccaagcttcttaacatcatctatgaggtcctcctagcctcacttttgctttttgataattcctgttagatttctgataaagagtcacttcctcaaggaagtcctttcttgacctcctaactgggttagcataatgttttcacagcccttagtcatttaccatagtcattctccactgaggcagtgctgctctctggaggtgtcctagtgactgggaggtgctcttgtcatttactgggcagggctgagagtgctagatgttcaccatgaagaattgtcctagctttgtatgacttgtaaatgtcttgttagatagtcacaaaggtgtaagaaatctgtttatagatatcagagccaagagcctaactcaattttacatatacatgtggaactttttgcagagttttaatatatgttgaattttctaggaataaaaactatggccaggcagggtggctcacgcctgtaatcccagcactttaggaggctgaggcgggcagatcacttgaggtcaggagttccagaccagcctggacaacatggtgaaaccctgtctctgctaaaaattcaaaaattaaccgagcgtgctagcacacacctgtaat

SEQ ID NO: 392094 - DNA, 236 bp, Homo sapiens
acattgacgaaaacggaagagaatctagacattaggaaacatttttgttgaagggctaaacagtaaatatcttatgctttactggccattcaaacattacaattactctactgcttaaatgcaaaggcagtcacaggctatacacaaatgagtaagtgtggctgtattccaataaaactatctacggacattgaaaactgaatttcagttaattttctcatattacaacaaactga

SEQ ID NO: 392095 - DNA, 340 bp, Homo sapiens
tgctattatgaacatttaagattcatgagaggaagtcaaaataccaacatgaaggggagtttagaagaggttgattccaaccctcatgaactttaaaatattaattgaagttaggctgtagtgagttaaagatgcatattgtaatcttgagagcaaaaataacacaaagagatcatacacccttgagataaatgtttctaaatggacaagaattttatcagattttggttaactttggaaagtgatccatgtgtacttgggaaggattctaaagttgctgggctcagcactctacgtatgccccataatggaagagagtcagtgtgtttaatgtatatcc

SEQ ID NO: 392096 - DNA, 337 bp, Homo sapiens
tgattatatactacccccttgataactctggcacagatctgggatttccctagctccagggcagaataaaaagtccctttcaccaaaaacacttgtgtccactgaggtacttccgtcttcacacagtggagaggggttagaggcttttgagtttggttgaggtaggtggcaactagctgaacgacagaaaaggagagttgccggttatgtgactaccaggaacctaataggtgaggaaagtggtggaaccttaggtgggaatgaatgcgtagcatattagggagatcgcgtgctaggtatctgagattccaaccatgaccaagacccttatgcccaa

SEQ ID NO: 392097 - DNA, 452 bp, Homo sapiens
atgaatttatatagcttattttaatgctatatatgaatttatatagatgaatttggcttttgaaaaacaaattaagtgcattaggaattttttctttaaaagtgatatgtttttcttacactttgcaagtttagaacttgccatattatgtttttgaggcaggcttctgtggatataatgtggggaaaaccatgaggtttttgcttgggatcaagtgggatttaggtgcatgccttttgtgatttaaagctattttaaagtgtgcttttaacaccatggaattacaattgttttctgaagtcaggtcaggactctgattctgcagaattatggtgaagccagtttctctttaacaagcaaaaaccgtgtcatcaaactgtacaaccaaaggacctaaatagtccattccctagtcttcagctgtacaaagatgaatcaatctctctgtctct

SEQ ID NO: 392098 - DNA, 225 bp, Homo sapiens
tggtgtgatctccactcactgcaacctctgcgcccagctaatttttgtatttttagtagagacagggttttgccatgttggccaggctggtcttgaactcctggcctcaggtgatccatccgcctcagcctcccagagtgctgagattacaggcatgagccaccatacttggcctattttattctctagtagataatctgggggaaaaacttgccttcttgactt

SEQ ID NO: 392099 - DNA, 157 bp, Homo sapiens
ctgcgacctgctgtcctcatccccaaagcctggctcctcctgcgacacactgtcctcatccccaatccctggctcctcctgcgacctgctgtcctcatccccaaaccctggcttctcctgcgacacgctgtccttataccccatcccgggctcctcc

SEQ ID NO: 392100 - DNA, 246 bp, Homo sapiens
ggcatagccatactgcaggtgatacatcctgtgtgctgcccactttgagtcctgaccaaggaagcagaatgccttccaggagttgcatacataaagctgcagcgtgatctgataaagagaaagagagcctctgcactttcagtgcagtccagcttaaagcctggaactagtttttgcatctctttgaatctacttgagtgcaggcccccaaactgggtatcagaccttgattaaggagactaacaa

SEQ ID NO: 392101 - DNA, 723 bp, Homo sapiens
cctctggtgtgacccccagcaggtgctaccacagtgccttgatcccaactccaggcaggaaaattacagaggttaggaaatgggattcgctcaggacagctgttctgtttgagctgaacagcctttccctgctgggcacccatggcactcagctccatacccagtaagagtggttcttacctagggagggtcaccaagaggacctgctcatgtgtttgaggggctattcaagggagcctgtctctgtgactacacaaatatagtctattttccaagtaagcttgaaaaaaaaaaggggggggtcctagtgggaaaggagtgatgtaaggggtgaagagatgggaagggagtgttgaactttttagtaaggcagttgacacatgatatgaggccacttcgatttacttgaaaaacaagtttaatttgccctgactctaacctgttcttgaggaaagaatgccttgaagggagagaccacctggaattgactggaaaagggtgcagctggctttctttctttgcttatggctctttgaggagaagatgggtttgggggtcccttcagaatattgtattcttttttgtttgtgttttgtgttgtttttagtagacatagacagggctcactgtgttccccagtctggagaacgggctattcacaggtgtgatcaagtgcacaccacagcctgcaactcctgggctcaagcaatccttgcctcccag

SEQ ID NO: 392102 - DNA, 286 bp, Homo sapiens
agaccgcattgagagtgacacggctaaccaccaaacctgtcttagaagtgacaggattcacaggattcatttaaaatacgctggtggtctccaggttggacattttacagttgaaccaattgaaaaaacaagcaagcaacaacaaatcctgtaaatctccctcttcccatcataacctttgacgagtcgacctgttctcccagggcacagggtccagcagcggcacctacagcctttcccgcagcacctcacccctcagtgtctgtgaggggtgaggtgctgcggg

SEQ ID NO: 392103 - DNA, 348 bp, Homo sapiens
acccacatagcagacactctgctagtactataactacggagtcactgtccagtttttcagagtacacagcaggtcctcttattagggttgccagataaatacagagtgcccagttaaatttgaatttcagataaacaacaaataacttgcggggccggagaagaataataagtatattccaaacattgcctgagagacatcttgtatttttatttgataattttttttttttaatactgagatggagtctcgctctgtcgcccaggctggagtgcagtggtgcgatcttggctcactgcaacctctgccgcccgggttcaagtgattctcatgcctcagcctcccgat

SEQ ID NO: 392104 - DNA, 463 bp, Homo sapiens
cttcagccctctgtgcctccctttgctcgtctgtcatcagggtaataacttttcctcctcacagggttaagtgaggaagaggtgagatgactcttcagtcactgagcagtgccaggcacagggcaagactgagtacacgcccgttgtcattccccctggctggagctcttgcaatcactgttatgcccccaccctgccctctcccattaatctgttaatgtggtgaattacattgataagtttgtacatctgtcttttaaaattgagacgcaatcttgttctgtcacccaagctggagtgcagtggcacaatcacggctcactgcagcctcaacctcctgggttcaagtgatcctccgacctcagcctcccgagtagctgggactacaggcacatgccaccatgcccagctaatttttatatttttactagagacagggttttgccatgttgcccaggctggt

SEQ ID NO: 392105 - DNA, 441 bp, Homo sapiens
cagggccattctcaggtgtgcttaagcattgctgtggggtgtgtttactatgcacacgagaagggatgggcagggtcgcagtctgcagcactgcccacggacagccctttgcatatggcgtttactgctgtggggttccttttctcaccatcatcaccccagctgtgctcccaaagttaacccatggaccaccggcctggcaccaccacaactgttccagtgtctgtagcctcaccttcagttcctactgggccgagaagccttggaggcagaggctcagcacccacacacccccacctacatctccactaggcttcgggtagcaggtccaactcctgagactgtgcagactcccattttccagaggcctctgctcccactgctccccacctacaaagcttgccccagggcctctacacgtgccgttcacagtgccaggga

SEQ ID NO: 392106 - DNA, 165 bp, Homo sapiens
ttcatttaaaaacaaaacaaagtgtgctattctctaactgctatacttaagcctgcagtctaggtaataaatagtaataaccaaatcaccattatagtaccaaagtactttaatttgtaagcgaagtgttgatgaagaaatacaaatagctcatgggatctttaa

SEQ ID NO: 392107 - DNA, 336 bp, Homo sapiens
ccgtctctgatttccatgattcagcctggggagtttccagagggaaaaagaagccctgctcaagcccagggagaccggtcttggaggcagggagaaacgcagccccaggcggagagcacagggcacacatccagctatggatggacacacatacccccacacactggccactgcgagcacccagagggtggcctggggtgagacatggcctcaaccccactagagtcaccccaagactgactgccaaggacagaacaagggacagcatttctatatccccgactccacacccctgaccctcttacacccctcctgctggggtgggtgccaaccatg

SEQ ID NO: 392108 - DNA, 269 bp, Homo sapiens
ccagcctctccggtagctgggaatacagatgcatgccaccacacctggccaatttttgtatttttgtagagatgggatttcactatgttgtccaggctggtcttgaactcctggtctaactgcctcagcctcccaaagtgctgggattacaggtgtgagccactgcgtctggcctacttattttcttctttttgagccttggcgtcagacactattaacatctgaacactcatcttgagactagtccacatatatgatgaccttacgtg

SEQ ID NO: 392109 - DNA, 395 bp, Homo sapiens
acctaattcacatcatcaagaaaggcctccagcaggaaatgtctaatctatgttaagaagaatgacaggaaacagtcaaatgaaggtatcagtaaggatcaagaaagacaagagtgtggatgagagaaaggatggtggatttagggaatcaaagaatcttggtagatggtaatggtaagagtgtgaagtatagagtgccttaaaataggctgggcgcagtagctcacgcctgtaattctaacattttgggaggtcaaggcgggtggatcatttgaggtcaggaattcaagaccagcctagccaacatcaaggtaaccattacaaccaaatagtgctaacctgcataccctacccctcacatgctttgcccagcccagcctgcataccccacccct

SEQ ID NO: 392110 - DNA, 305 bp, Homo sapiens
tccctctctctttcttctcatgggatccagcgtggttatcctggttctctggtttctctggagagagccgaggctggaaacctgaatatgggaatttagatagtgtttcagagagatgctgtggaggaagcctctctctgatcaaattagatctatttttgagagagagaaactccagagggatttccagaaaccatgatcagaacagaggcaaatggtggccccatgagtctgcaacaaagcaggtcacaattgttaagacttcagctcactgttgtctggaaactgggccaagattaagccaa

SEQ ID NO: 392111 - DNA, 382 bp, Homo sapiens
ggtatgaacggcagagcctcccgggagcctgcccacccacactctcctcatgaggtcccctttcattctccatcttagccggagattctttccttgcttatgctgagtacaacctgcaatcattatatggatttgattatttgggtttctttctaataatctccctcatataagctccaggagggaaagaaccataactgccttgcatcccctttgcctgggacagtgactggcacagggtggatgctgaagacgttggggcagtaggaatgagtgacaatgggtcaagtgggtgcctggcgggagtccctctgggagggtgtgagtgatgacgggttgtaggttgactgtggtatagacagcaagaagaggctgaactcaa

SEQ ID NO: 392112 - DNA, 310 bp, Homo sapiens
ctgagggactgcccacaccgtgagttggctgtagagcccagaccccaacaggagtccaggaaaactggtttgaaatcctgcttctgcttactgctgcctgtgtggcccaggccagtcacttggcttctgtgagcctcgatttcctcttctgcaagaggggtcatcaccatctaactggtggagttattaggaggtaggcaggacactgactctgtgccaggctccaagagtttacaaatattaattatgaggactaaccctcgtaacagctttctgaagtagatgctattagagtccccatttaattaag

SEQ ID NO: 392113 - DNA, 321 bp, Homo sapiens
gaccctgtctcacggaaaaccgaaggagaagacaacccgtactgcaggctctgggagatacaagtcaggaaagaaagaaacaagacaaggagagaaattaagttaccttcccatggaggaatgtgggaaggggcttactttagtctgcatgctagatctaagcatggaacaaggatccccttgtggtcctattaagtgcttctcattcattagacttaagtctacaaaaggaaagtacaatgcacattattttagaaacatcctctcccctgcccctcccagcggaatcaactccaagtacaccctagttgattcaatgca

SEQ ID NO: 392114 - DNA, 152 bp, Homo sapiens
gggaggagaacagatttatgcccttaaaaaagatgtctgagccagtttttgtccagtctgggtcctttgtctctgaagtgtctcatccacagcacggtaagtaaggcaagaagttcagtctggagaatagagaaggaacagtgggttcgggg

SEQ ID NO: 392115 - DNA, 565 bp, Homo sapiens
agtgtgcagggagataaatgataaagataaatataatagtgaataggagtaacaatagaaggagttatagttcaggtactatgggaactcaaagaaaataacatatcaggtgggagagtctggaggaggcatttgagttagtgagttttgaataggcacaatgaataggttaaggagcattctacctcaagggaaaaacatgacccaaggcactggcacttaaacaagtgtgtgttgaatagctgaatggaattgggtagcgtttgttcttccactgatttactcactatgatatatgaatgcctcctgaatggcaagcaccatggcaggttggtgctgggaatataataagatgaccgtcatgaaactacagtctaatagagatagataaaaccgacaaattaatgaatatataaatccaaagtgagaaagactgttaggctactgagtaacttgagtgaggatagatggtatgattaggtagtcagggaaggactctttgaggaaacaaaatataagctgaaactgatctttgttaggagccagtttacctgtaggatattta

SEQ ID NO: 392116 - DNA, 1518 bp, Homo sapiens
  misc_feature (533)..(533): n is a, c, g, or t
tttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactnaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcactcccaaagtgctgggagtataggtggtgagccaccacgcctggcctaaatgaagtaccacatgaccgaccgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggagtataggtgggtgagccaccaaggcctggctaaatgaagtaccacatgaacgacggacgacctggggaaaatagaagacccatctcttcaaatgtaaaaaaaaacggggctccattcggggcggaaaag

SEQ ID NO: 392117 - DNA, 3044 bp, Homo sapiens
  misc_feature (533)..(533): n is a, c, g, or t
tttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactnaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaaaaaaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgaccgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaa

SEQ ID NO: 392118 - DNA, 3416 bp, Homo sapiens
  misc_feature (533)..(533): n is a, c, g, or t
  misc_feature (3416)..(3416): n is a, c, g, or t
tttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactnaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaaaaaaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgaccgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaaaaaaaaaaaaaaaaaaaaaaaaaaaaaaaaaaaaaaaaaaaaaacaaaaaaaaaaaaaaaaaaaaaaaaaaaaaaaaaaaaaaaaaaacaaaaaaaaggagggggggggggcgagaaaaagagccgaggggggagcacagagcgggccgccgcgcacatatgaaaaaagcgacccagaagaagaaacacaaaaccagcaagcgcaaacagaagaaataagaaagagaaaaagttacgagacgaatagaaaggaaataactacaggaccaacacgggacaaaccaaaagcaaataaacaaagaaaataagacagacacaagatgccaacgagctaacgcccggacaatggaaacaggtaaacaacataaagcn

SEQ ID NO: 392119 - DNA, 3004 bp, Homo sapiens
  misc_feature (533)..(533): n is a, c, g, or t
tttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactnaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaaaaaaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgaccgaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacagtgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcgaacctatgagggatcctctgagtcgtc

SEQ ID NO: 392120 - DNA, 2586 bp, Homo sapiens
  misc_feature (533)..(533): n is a, c, g, or t
tttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactnaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaaaaaaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgtcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaa

SEQ ID NO: 392121 - DNA, 1640 bp, Homo sapiens
  misc_feature (533)..(533): n is a, c, g, or t
tttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactnaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagtcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaa

SEQ ID NO: 392122 - DNA, 317 bp, Homo sapiens
gcaagatcagcccggggattccatccaccccttcccccggaccctccactctggttaattccccctcagctggaagaacccacccccagttcacccgggagagtcccacgtgccctggtcctgcccaggtctcatcctgtggagcattcaacccagatggaagcagccccggttctataacacacagtgcagtcttcccgccctaagacccctgcggtggcacacaggaagcgcagattctgatgtctgctggcacatgttacacataacacataacacataacataggtatgtctgcctcgtagctgatagactct

SEQ ID NO: 392123 - DNA, 384 bp, Homo sapiens
tgggggtgtgaggagggggaggaacacatgtgagatccatgggaagaggcggaatggactgcagcacagggactctgctgcgtggcttctctcttggcagcagagggaaactaagagcctcttacgaactggctcctgcaccttagtgggactgggggacatttaaactacctaaagacctggccatcgccttaatggagtttaggaatccactcagtattctgtggcaggcttcggctgctggctggtccttttcattcttgcctaagaaaattcttgaaatgggagtctcaaaatatctgcaaagtagctacaccaatagaggtaggtagctatttttttttttgagatggggtcttgctctgttgcccaggctggcacgcg

SEQ ID NO: 392124 - DNA, 492 bp, Homo sapiens
gaacaaattccaagctcttccctgcagccttgaaagtgctatagccttggcccctgctcactgctcctacctcaccccagggccctcctctgctgctccagccacactgtccttcctggactgcatctgacacatcaggttcttctctgctcctggctttggcctggcagttcctactacctggcgtgctcctccccagccaccttccctcagccttccggtctcagctgggccctctgcaaaggcctcctgatgctccagcctaggtttgagcaatttttcattgccacagatcccaaaacttctctccagcacttcatcttcccaatttaatgactcggttattcagtatttattctattataatgatctctttcctgtgctagactgtgggctctgtgaagacagggaatgtgtctggcttgtcatctgcatagtccctagcatagtaccccacatggtacctgacatataacatgtgcttgataaata

SEQ ID NO: 392125 - DNA, 517 bp, Homo sapiens
tagcgtgagacagagaaacaggtggagattttgtggattttattctcattcgataatcccatggtaaaccctaaatgatcctctttctagtgacaggaccatctaggactcacagaggatacaatttgtatggaataacctgtcaagataagcagagtatcagatactgacagtccttcattgtgacctcttatgggacgccattacctggcttggttttggcctagtaatttcctggctagatggatggaatttgggtctgttatttcaggggcatatggatagaaccaataatgtaaatttttgtttgcttttcataggcaatttgtggttattaaataattacgtaagatgtaaagtcctcagaagaagtggtgcttaacttgatatatgcatccaaataacttagtggctttttcaaaaaatatatgattgctactcacttctagagattatgactcagttaactcaggatggaagtcagtgtatgtgagtttttaaaatgcttccctgtgaa

SEQ ID NO: 392126 - DNA, 827 bp, Homo sapiens
aaactcattgtatagtcttttatatctttgacaagatcagaataatatattggactcagcatatacatttacatacaaattggttcatgctggacaattctactaaaagtatacacttgaaagcattatatcatataaatgttagttatcattattttataacctgtgtcaaactgagtaaattccttcaacaaatagagaacagaccttcatttattcaattttgttcactcgttcatcaatactggagatttaggaacaaactttttcctgttctcatggaaattactgtctagcatgagagacaagttaatataggtataaaattgtacaatgaaacagagtacagagcacagtaggcatacacagtagagggaacctaacatagtccagggaatcagggaatgtatctctaagaacataagtctctgagtaagctgagacctgaaggatgttctagaacagatactagatccagaggactgagaggtctaggagtcaggcaaggtgatttgggtgtaagggaagagtaggctgcagccattacatatggtatattagatacttcaaacaactctaacctgttctacttctagaaaactcttaagggcacagtgcatccatgtgagatatgcaactgaaaattaggtcactttattacaacaaatgaaaagcaaaatacacaacactaaaataaaatatcaaaaaacaggtatataagtaatatgaccaacagctacaaaataaaggttatattttaacactttgttttatttatttatctttttttttgttgagaatgagctcactctgtcgcctagcctgga

SEQ ID NO: 392127 - DNA, 360 bp, Homo sapiens
aacagaaatcatttatgacacaataggagagatttgaacactgagtggacagttgagacatgaataaattattctttaatttttggtgtaattatggtattttcttatgtttgtgaaatattaatgactagaaatacatactaaaacaattacatataaaatgatatgatgtctgagatatgcttcaagacaatctaagttggaattggagggtgggtggtgtaaaagaaaataagagtggccatgagttcacaaacaatgggggtgcactgttccccctacctttatatgtctttaaaaaattataattaaaagtctttttaaaagccatcgtcccatattaatctgtgatactggaag

SEQ ID NO: 392128 - DNA, 369 bp, Homo sapiens
tgtgtaatcccagactacctcccccttcatgagtttttgttcatagttttctggttagctcctgtattttttcacagctctaaattttggagtttccccgggtttgggcctgacctttcttctttatatccatatttaatccctgtgttctcatctagttccagagctttaacatcctgtattagtgaaggactctaacactgaacctccatcactgacctctcttctgaagtccaggcttatgagtcatcagaattcgtatttgacattttcacttacatatccacttggcatctcactcttaacatgtcaaaacagaaatgattcaccttcctttagcacctgcccactgctcccccaccccacccg

SEQ ID NO: 392129 - DNA, 426 bp, Homo sapiens
aaccaggtctctagcttcatggccctcataccggaacatcagcttcccgctgggtctcaaactgcatggccctcaaactggaacatcttctcccccgcacaggtctccagttgcatgaccttcaaactgttacatcagctacccggccctcaaactggaacatcagctcctgccagatctccagctgcatgaccctcaaattggaacatcagctcctcctggagtattcagctacgcgaccctcaaaccagaacagctcctccccgagtcttcagctgaacgaccctcaagctagaacatcagctcctcctcaagtcttcagttgcaagaccctcaacttagaacatcagctcctccccgagtcttcagctgcaagatcctcaatccagaacatcagctcctctcccggtctgcagctgcaagacc

SEQ ID NO: 392130 - DNA, 280 bp, Homo sapiens
taaggcagggtactcttgtaatggacagaaactgacaaaaagcaaaatatattaagttacataatatattagaagataaatctgttaagaaataaggtaacggctgggcacggtggctcacgcctgtaatcctagcactttgggaggccgaggcaggtggattgcctgagctcaggagttcaagaccagcctgggcaacatagaccttatctctatagaattaaaaaaaaaaaaggaaatcagcagcccagccaaagactaattatttgtaatttctgtg

SEQ ID NO: 392131 - DNA, 474 bp, Homo sapiens
ctgctagtgctgctgcttcaaaaagttgagaggaaggcatgtatcaaaaggtctctcaggacatgttgttctatcctgtttctctgctgtgggatcaggaatggaatttccaggaacctccagttctctgcacccaagggtatataaaaggaaaaaaatcagctgataaggaacacttcctaactcattctatgagaccagtattaccctgataccaaatctagacaaacataccacaaaaaactagaaaccaatatccgttacaaatacagatgcaaaaatcttcaacaaaatactaatggtgctttatgaatgtggcttcaagcctaaacaacttgccttcccaaaccccttttatatggaaatccaattctgccactacattgttctttgtgaataatacctaaaatcatataactcctctgcttaaaaacctacagctcttctttacctaaagaaagaagtctagatagc

SEQ ID NO: 392132 - DNA, 825 bp, Homo sapiens
tgcatcagtctccctttgaggccctccacaattgctgccaccactctttaagtggggttaaatcagagccagtaagtgacaatcataaaaaagcagttagtgggccaccccacggcttgcccgatatggcacattagggctctttcttttcttttcccagcagtcttcggccgcacttcatcctgagcctagcatctgcaggaggccaaggctggtggaccgggggtccgggatttccaaccacctgccaaggaaaaaggaagtcagtgctggaggagggaggaggaggaatctacatattctgcagaccttcttgtttatcatgagcgagggcaggagaatcgttattaatggtatcaggccattgtctttcttatgtgcctccgagggcagcggacataattaaagtccaagctgagttcatttttccccctggtggcttaaatggcctggagtcatttcccatttctcccttcccactagcgccagtcctccctcgctgctgaaaaattcaacattcctataaactacagtacttcgtaaaggtcacgcgccagttaatctgaacctggggtctggcgccagccccgctcacggtggctgcgaggatggccatgcagcccggtcacgtggggcccgcctgtggagaacggagaggggcacgaggcaggcacgcagagctctttaaatattgctgagcatttcctggatcagcatgatatttaaagatttttgttccacctgcctgcgaaatatagagtccagccgagaggcaagaaaatgaatatggatttcttgccctttcagtgtattcactccagaaaa

SEQ ID NO: 392133 - DNA, 867 bp, Homo sapiens
ctagcaaggaggccagtgcagctggagtgtggaaatggaggaagttggaggtagacaaattatgtgaggccacagtaaggttttgggactttattctgaggatgacgagaaaccagttgaggattttcagcagaaatgtgaagtaacccccgccccccggcctggtgttttaaaagaactactctggctgctttgtagagaactgcgtggtttgaaaggagcacccaaggtgagcaaaaagacctgcactttatgctactctcacttaactcactctagggctgtgtgcctcaattctttgcctataaaatggaggtgagagtggccgggcatgttggctcacgcctgtaatcccagcaatttgggaggccgaggcaggcagatcacctgaggtcaggagtttgagaccagcctgaccaatatgatgaaacccccatctccactaaaaatacaaaaattagccgggcgtggtggcatgtgcctgtaatcccagctacttgggcggctgagacaggagagtcgcttgaacccgggaggcggaggtttcagtgagctgagtttgcaccattgcactccagcctgggcaacaagagcgaaactccgtctgaaaaaaaaaaatggaggtgtcccttcccaaagaacttccttcagaatctgcaagaaagatcctgtgccgcctttccggggtcattgtccacgtctatatccacagttcgaccgggtcatggtgaatgggtgcaaaaggccatgttaaaccttgtaaaaaaattctatactttgtcacagagatgaacctcataaaccgaaggagctaaagctttgaagaaatgacaagaggatgtttaaaatgtccaaccaccttggaga

SEQ ID NO: 392134 - DNA, 177 bp, Homo sapiens
ccactgtcttctagaagtgtattagcaagtctcagtctcaagggttagagagccaggaagagtaagttaggacggactctgttacagaactctagaggccagagcattggggctcctttctgtccttccgcctcagttaaacagagacaagtccgaggccttccaggaggaagatgc

SEQ ID NO: 392135 - DNA, 826 bp, Homo sapiens
ggaaaaggaaaggcaaatagctctatctaaccaaaattctattcatgtgagggagcaaaagatgatacaagaggagagtttcttctgacccccaaatcagctttttaatggatgaagctctttttgtccagagttactgaagcttctggatgttgttaggaatttaagttcccagacagattcagtaaaatactatagcagtccagagaaaaccaaataaacttgcagggagagggagggaagggaaattctaagtataaaagataaatctacagctaaggttgaatggctgttacaattaaatttttttaaaactaggagaaactgactaaggatttcaaatggaatagaaactgtcttacactttagggtctaaatgaaaggcatatacatttaaaatgtaaaagaaagaaatatatcatatgactttcttcttctttcttacttttttgagacagggtctcactctgtcacctaggctggaatgcaatggcgccatcatggctcactacagcctcaacctcacaggctcaagtgatcctcccacctcagccaccaccaccaaagagctaggactacagccgcttgccgccacacccagctaattttttttatcttttgtagaaacagggtttcaccatattgcccaggcttgtcttgaactcctgggatcaagcaacctgcccgcctcggcttcccaaagtgccatgattacagtgtgagctactgcacccggcctcatatgattttgaataaggcatttgctttatgctttacaaggtactagtagtaaaaactgtttagagtgatgtacataaagaacagt

SEQ ID NO: 392136 - DNA, 355 bp, Homo sapiens
attaagcgccatgggagacacgtacacaaatgcagcaccttctggaacccagaaggaagcatcacgatcttggcctgagtagggaaaggaatgcttcacggagcagacgacatttggtttgggtctggcttttcattctcttatcagaaaggtgatataaattcctaacgatacagtcacttagtggtttgctagttgtactctgctgctgactggctctgtatgggcatggccatgtttggtagttgttcaggattcctatctcccaagaaatgtggcaatgctaagtaactttcatttatgaccttgtgcagtaccttgagcaattaggggctaaataaacacaacatctgaa

SEQ ID NO: 392137 - DNA, 535 bp, Homo sapiens
ttctgggctgtagtgtgatggacgagcctcctcagtaggtccagttactggcctgcagtctagtctctacatggacttagggatcaggtgtcctaaaaagtcctgtgaggtttagaagatgacagcccagagagacaggcttggactctgagatccttgttcttttccagctgtcggtgtctatgaacagtcctttccaggggctgctgtgggattgttaaccctgtagcatctgacaggcctttgttctcagagttgaaacagaccttagaggaatttagtgtgacctttcttctggtatagggactcccacaacaggcttgtcaggaagccgttcagccttctcttgaacttgagtagaagtgcctagtttgccaccaccatccaaatacctgccccattgttgggcatcttcatggtagtctagcgtgcacatagatgaaagccacacatattatatgcgcgtagcttaagaaaactttttccaagtaagcacacctgtgtaagcagcacacagctccagaaatagagcatt

SEQ ID NO: 392138 - DNA, 662 bp, Homo sapiens
cttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccgtgggacagccccgccgcccctccccaccagggctttgcagatgtccttgaaagacccaccctagagccctttggagtgctggcccctcctgtgcccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagatcccccacttctccacggaagccccatcccaaagctgctgctggccttgctgtaaaatgtg

SEQ ID NO: 392139 - DNA, 729 bp, Homo sapiens
cttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccgtgggacagccccgccgcccctccccaccagggctttgcagatgtccttgaaagacccaccctagagccctttggagtgctggcccctcctgtgccctctgccctggtggaagtggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagatcccccacttctccacggaagccccatcccaaagctgctgctggccttgctgtaaaatgtg

SEQ ID NO: 392140 - DNA, 807 bp, Homo sapiens
atccaggaggttcagaagaaatagcacagagtgaggacagcagaggtaaacatgcctgcagaaacctttctcttggcatgcagagcaaatactataatccaggtgtctcagccaatgaggcatttaaacagatacagaaaaatcattaaagaggatttcagaagggtatgctcacctggacagattgcactccatccttccagtgtctcctgaactgctctccaggaatcattttcatcagaatcactggggcatttatgattcaaaaatgctttgaatgtggcagtgcctgaatctacagttttccatgtgatttttagatatactaatgtttgagaaccactgctgtcaacagcataattctgtaagattcaaaatactagttgtaaagagttaatttagctgaaatgcaaattttgatttgacctgctcccaattccagacctctgaaatcagtaatgacaagaacctttgggcattttcaggctcagtcttcagaggcttatcctatagagaagaggaataatttctgtagccacatcccaaagtaggggagatgggccactaggtacacagctgcctttgtgaagaagcagagtaggaaatatctaccctgcaatgattggggcacaggaaagctggaatccaccttattacaacagctggttaatgtcatactgtgaactcattgagcacctgctttgtgagtattcattttctatttttaaattttgcatcaaccttgtgaggtttttggtatgtttatctccattatacagatgaggctgctgaggctaagagaagtca

SEQ ID NO: 392141 - DNA, 363 bp, Homo sapiens
  misc_feature (12)..(12): n is a, c, g, or t
ggtatctttagnatcaataacgagtaaatttaacacacgttcttgaacgacatgctaacagcagtaaaacagaactgtaggtgtggaaggttttcaaatattttaagaggattagttctaggacaataggtataaaatgcttaaatcaaactaccttaaccactgggcgaccaggtctttactatggacagtgctcagaaatttgtgaatctaaccagttttatacctattgtcctagaactaatcctcttaaaatatttcaaaacctgatccacatctacactaaaatatcactgtaaagctattcagcatttaccttttaagttaaagattgacggagtctacacctctctgcagtgaatg

SEQ ID NO: 392142 - DNA, 400 bp, Homo sapiens
tcccagatcacagctctcaccacaaaatacttctgccatcctccaatggctcaatctcccccacctataccaacaggagatttggacagacaccctctaaaatgacccttcaagcatgctatgggaagccatgtgggcaaatgagaagaacaagcattagaatcaaacaaaccaggttcaaatcctagctccaatctaccaaatatcaaattaggtcacttcagacaagttatgtaacccacttgggtcacatttcatcatcaatgaagtggtcccaccatcacccacttgataaggctgctgtgaagatgatgtagagtaattaaagtgcctcaaaccctgcctggtgctgagcagaagctcagaagtgttggctcttgttccctccatggcacagcaa

SEQ ID NO: 392143 - DNA, 395 bp, Homo sapiens
tagatgatctaaaatgcaatcagctatcaaatatcaatgacattttatcacagaaatagaacaagcaatcctaaaattcgtatgggaggacaaaaactcccaaatagccaaagcaagtgtttagccaaattcacattagacctcaatctctgcttatgtgtccgagtctctgagtctaaaggaaggtcaaggaggaaactcagatggaatgcgttccccttcctatcctccaaacatggattaaattagaacagagaaagcagggagactggccccagcatctctagctggaactaaggccgtggcaggttatacaccacgcacaagaaacaccagccaagcaccacgactgacaagctgggtgccactgccacctttgtttcctgcctgtgtct

SEQ ID NO: 392144 - DNA, 147 bp, Homo sapiens
gttgctgtcttatttctcccttcctttagaatcccttctttttcaaaacactagaaacctcccattatggtaagtaacctttagcatgaaaactgttgcaacgaagtgttaacatttcacagattaattggcatataagaaaactag

SEQ ID NO: 392145 - DNA, 226 bp, Homo sapiens
gtgctgttttgcaccatgtcctgcatgcacaaattcacaaaagagcttttctattttctggcaatagcctcagtctttccactcttctgatgctaagggctgagttaagggattatgtaaacatgtacaggtgacatcaagggagacaaagagttcatgaactagaatcctactgcaggaggcctcacggagtctacagcaagagtcagtgacggattcaaagaag

SEQ ID NO: 392146 - DNA, 470 bp, Homo sapiens
tagcaggatcctgatcagagcatacccctaacaaaagagccagcctgtcctgtgaaggctttcaagccaggcattgacttctcctctctaatcttagctggcatcttccagtagaaggcttttgtctacattgaaaatgtgttgcttggtgtatctaccctcatcaactattttagccagatcttctgggtaacttcctacagctcctccatcagcacttgctgcttcacctggctcttttatgttatgcagatggcttcttcactgaaacctcatgaaccaacctcggctagtttcaagctttccctatacttaaaagagatgtgtgtgcaacatttttctccgtccttttagccccccacttcctgttcccctcaccctgagtgatattacagctcctaatcagaactctcctctaagaaaaactgcaagacgtcaagccactaagcctgtttacatttgctaatggg

SEQ ID NO: 392147 - DNA, 282 bp, Homo sapiens
ggctgtaagtttatttaatgcaaaataatcctctccaactttactgaggtggctgaccacctccacaaccaaatctgcctctaaactggaattccgtctctgacccagccccagcctcagcctcagccttcctgtcggcatcagggggcacagcaatctgcctgtaggtatctctgtcggcttcccctcttgtgagtcttgcaggtcgctcacccttcagacctttaggctgaggcctgccagtctcagaatggctgcggcgtagggtggcaggcacaatct

SEQ ID NO: 392148 - DNA, 529 bp, Homo sapiens
tggcctggaaattctctttcttgagtttattaatgccttaatttcttagtgctaagtgtatgtgttttcagcatgtatcatgttaaacgtgctgtgattttatgttctatttcttccatcatttcgtattttgattaagtcctgtagattctattgctgaaaattcatttgaatccatttccttttttcaatttcctctgatattaaaccttagttgaaactctcatgaccactcttctgggatatttttgaaggtcacagatgagaaagtctacttgcttttatcatagtgaagatacagatacttagctttatggaattgacattaataaactgtgaaaataatgttcactttaaagaaaagatgtaattgtgtctaaattgaacctgaacttatctaagctgtcattgaggtggcagaagttgctctattctttcttggctgtgaatataaaagtaatgacatttatttagtaaatatgggctcatttctctgaagtgcactgcgatttggacacatcttctctga

SEQ ID NO: 392149 - DNA, 408 bp, Homo sapiens
cccccgcccccaactcaaagcaactcaacgacgagaagcacctctggaactgaggcaggagccctgccgtctggatggagaatgccacacagcatgtacacaggcaggcatcagctgttcaatcactcctgccgacctggcccctatttttacagcatgaggtgggaacacagaaaatgtcactatttagaaatcccatctccagccacatggtagctcattttgggaggctgaggcgggcagatcacaaggtcaagagatcgagactatcctggccaacatggtgaaaccccgtctctactaaaaatacaaaaaattagctgagcgtgatggcatgcgcctgtagtcctagctactcaggaggctgaggtgggagaatggcttgaacccaggaggtggaggttgcag

SEQ ID NO: 392150 - DNA, 536 bp, Homo sapiens
tctcaaaatttaaaaaaattaataaatctttaaaaatcagccaggtgtggtggtgcacacctgtggttccagctacttaggaggctgaggtgggaggattgcttgagcccaggaggttgaggctgcagtgagccatgattgtgccactgcactccagcctgggcaacagagcaagaccatgcctaaaaataaataaaaaataatttaaaaaattgagaaagatgggaggagggtgattgcatcttgattttctctaaactttaattgaaattgagcttttccttccatggcgaatgttgctaggaacaaacctcattagtgttagcagcacctgttactttgttaccaacagaaatcacagatattttcatattacactgcagctgttgcagacatctcgggatagcatttttgctcatcattacctcaaaattatagtaattagacctaactttggatcttgttatttaatgtgccaataaagcatatcatgtaatatcacaaatattttcataaactttattttgatataattt

SEQ ID NO: 392151 - DNA, 291 bp, Homo sapiens
gtcactgcttttgaaaataggccactgagaataatcataagggaagttaccttgaataggaaaccaaattcttaatagcattagcaatagtaatcttgccaattcagatctatgcttttcactgtctaaacaagctcatgcttcttccagtgtctgttaaaattgtgagttataattcagggatgatggtaaactacatgataaagctgtctgtttgctttgaaagtattaagagtatttttctttgcaaaatggttgatacaggaactggtttcaagaagcaggaactgg

SEQ ID NO: 392152 - DNA, 372 bp, Homo sapiens
tagtcatacatatctgtagtcccagctactcgggagactgagtcaggagaatggctcgagcctgggaggtcatagctgcagtaaaagatgactgtgcaacagcactctagcatgaacaacatagagagacccccgtatcaaagaataataataataaataaaagtatttagacccaggggagtataaaacaccaaactaagaattattatttctccttctagaattgaatataagagaatattaaatcatagagacaaacagtagaatggtggtgacagtgatgggagaaggacaaatggggaattactgtttaacaggtaaaagagtatcagatttgcaagatgaaaataattatgagatgtttgcacacc

SEQ ID NO: 392153 - DNA, 521 bp, Homo sapiens
ggaaagggaggaggagaatgagggatggtagaagcctgctcggtcaatctgaaccccctctcttcgccagtcccctgctgcgggcagcaggcaattcagacctgagtgcaacagctaattaaatcaatatgagataatgaacggcaattagaggtccggctaggcacatcttctcttgtaaatactgtttctctcccaacggggagctcttttttaataatctgtttgtgtttcatttccaggagccgtaattcccccaagaagcactttgggaaagtgatttgtttgtctgtataatcgtcaaagcattccgttagacttgtttgttttgctgagtgcctgctactactggagggaaacaatttttcttctctcttttattttttttttaaacgtctgcttccttcctaaacatcctaatgttcgaccagtccagggccatgcatttcagaggtgtaatgagctgcactctgcccctagctccctcgttgacattctgggggatgaacaaatctaaaatc

SEQ ID NO: 392154 - DNA, 397 bp, Homo sapiens
ctagtcaatattaataaacattaccgaatgcttttacaacacaatttattttttaatacagctctttatgtatgccataaagtaaatataccaataaaagccaaggatttcaaacaacagattaagaaaaacaaccaagaactaactgagtgctagttaacaccttccatgctgcaggttttgggagcacacagcaggtgcctctctgctggggatccagaccaggagagttagggaagacagtggccatttggttgttttggaaccgtttaaagggagagagagaaaataccaaaccagctgtgttttcttaagaatcacctttaaaacagtggtatattgaccatgtatatatgtgtacatatatatacatcgggctgagtgcaggggacctggc

SEQ ID NO: 392155 - DNA, 745 bp, Homo sapiens
atgctatgtatacctgcatgtaaacaccacactgtaccctataaatatgtacaatgattatgtgtcaattataaataaaaaaatatcagcccttggataaaacaaaaacaaaaaagaagaaggatacagaggttgctttttgaattagaatgtctgaaacaagatctgggtggtaggaagaaaccaaaagttgtttgggtctccctctgttgcaaggttggagtacagtggtgcagttgtagcttactgcagcctcacactcctgggctcaagtgatcctcccatcttagcctcctgagtagctggaactacagataggtgccaccatgcctggctaattttaaaaaattgtttgtagagagggatcttgctttgttgcccaggctggtctcaaactcctgacctcaagtgaccctcctgccttagcctcccaaagcactgggattataggcatgagtcactgtgtctggcctgaaccaacatttgtattgtgtggacgtgtgcacgtgcatacacacacacacacacaccctgcagagatatcagcctatgagtaaatagtggcccatgatattgcatatgttctttgacctatcattcaacaagaaggtttatgaatttagaactggtagtcaactgtggacttgttgattgcctttgttttcacagctatcctatgcactcacttgagagcattttctgtgatgaattcaagcactagcccattagtgagcatttaccttaa

SEQ ID NO: 392156 - DNA, 399 bp, Homo sapiens
tgtctatgaatattattatgtccctctgtgaaatacaattaatttagctattaattcatcaactaaaaagcacgtgactacctctaatatctagtaaaggtaaatcatttcctagcttgggagtagacttccaattctaaaatgagagacaaaaaccacccagaaaggtaaatcttcccacacggtcagctcagtcttcaaggttaattatgtccgaacaataaagatttaacaaccctagagacaagctgactgtaacaggtgagtaatctcccagctcagactggctcagtggatcctttagtttcattgaagaaagcaattagctttcagtgtgctaggaagtgggaaacagtttcacagattagtagagctgagggctctgtctgctggtgaagt

SEQ ID NO: 392157 - DNA, 561 bp, Homo sapiens
cagctacctccagcagcaacctgcctttgttgggcgccagggctcaagctggggagcctggccaggtggctgcccacacctgtgttcaaggcccatttcggtccagcccagcagaggcacagagcagatcagagcccctgctgcctgcctggggacttcaggggagcccatcctgaggcctcatgtcctcacctgtgaaatggccaggtgtaaccaggagcctttaagcactccatgactctgtgcagagtttcatgcacatcattcatttgttaattcagtcattcaacaaacatttattgggcacctactgtgtgccaagtactgtcttgtctctgagagtacaaaggtgataaatcagataaaccatcccttcccttcttggtgttggggagtcaagcaatatatgactaacgcaatgcatgcatgataggtcatggggatgacatgttctgtgaaggagagtagggcagaggaaggagatgggcgcaaggaggggtaagcggttggttgtattttattttaatggacacatgtcacctattagaaaacacctgtagg

SEQ ID NO: 392158 - DNA, 235 bp, Homo sapiens
ggctgattgcgtctcatctaatatgctgagtgaaagaagctagagaaaaaaagagacatacgtatcattcccattacatagaactctaaaaacgtaaactaatctatagtgacggaaagagatgatgaagacttttactggagagtaggagtggaaagggacagttttaagtcatttgctgttagaatttgagctatgaagaaaggaagaagttataaaaatttcaagattttaa

SEQ ID NO: 392159 - DNA, 285 bp, Homo sapiens
ggacagctgcctcaagtattcattcatcaaataattattaagcacctactgagttccagacaggacaggaagttcctgcatgctgttgctgtctggtggggggaagtaaaaggagtcagctcttgtgtcctatctggggaaagcagaccgttacacaggtcataacacgattatttaatcatagtcttgggaaagcatcgggatgctgagagcataaatggcagaagagactcagtctagggtggtcaaggcgtccctgaagaaatgatgtttcagctgagacgg

SEQ ID NO: 392160 - DNA, 151 bp, Homo sapiens
agagaatcatagagaaagatgtgggaatatcttcattttgccgagaaagaggtggcatctgtatctatagcctctcctgtcttagagggaagtaagtgaggagtagtcaaatgagacatgatgaaatgagcatcaggattctgtaatacag

SEQ ID NO: 392161 - DNA, 623 bp, Homo sapiens
cgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatga

SEQ ID NO: 392162 - DNA, 232 bp, Homo sapiens
ctgtccaccggtaatttacgctaaacgttgcgatgaaacaccattcagcagtaaaaaggggcacactttttgtgtgtatctaacacaccacaatattaatgaatcttaaaagcataaagccaattgaaagaagtcagatacaaaagagtatgttctatatgattcaatttatgtgaagttctaaaacatgcaaaacttataatggtgaaaaccagctcaggccacctggggt

SEQ ID NO: 392163 - DNA, 422 bp, Homo sapiens
aaaccaggctgacctgtttctgccattatccagcaagctgctccttggcttggggaaggaaagctggctcgctgccccctgcactttttccttaccccacccaccttgcagtgtgacttcttccacttcatcctgtccccgctttcctcctccagtggaaacctgtaagtgcttcagtgctcacctctgaggcccacactgagaatcctcagggtggaggacggaccttctccactccccaacccttgtggttcctgcagacctgtccagctgtgtatggggtggaactgtctgagtcacatctgagcagcaagtttgtctaggcgtgaccagcagccaactcagtccatctccatcctgccacttgccagggacaacctgcagaggtatctttacctggggacaaatccctgttccttggc

SEQ ID NO: 392164 - DNA, 672 bp, Homo sapiens
agcaattagattttgtaggtgccacagttggaaacatgaaactccaaggatgatggtgagacagagcagttgttgtagaagaaaaaactcaggaaggactgagtgtctaatgtgttctctcaaaggcctgttgctgaaggagggtggcagcaaatgaagtcggagaggggaagagggatacagtgttcaagacaagatttcaaaggagaagcaagttgatgatggagagttgcaaaaggccacgtccagatggctggcactctgccacgtgccgtggctttgatgctttacaggtgttctctaaggcgtcgaaggcggaagctccagggacctgctgtctgtcattgaaacagccagaggactcaggacccagagaaagagcaaactccctctcctttcattcccttccgctcttgtaggaatgtgggaactttcacagttttgctgttttcaagaaaacggcaccttgacaacatgacctttgagacctacaagctgagggagctgtagggagaaggatgatctgagatgggcaacaaaaaccttccaagaggaggcaatgggtgaggacccttcatgttgccaataggagcgatctgggaatattttgaaatggacttttaaaaaagctgagtctgttttttggaggttctttgtcaaatacacaagaga

SEQ ID NO: 392165 - DNA, 793 bp, Homo sapiens
catggcacttagtaggcctgagcacatttgctcccacctcagtgacctccttgttaacacgacatctcctgactttggggctgcagagtgatgcagagcactggccagtgttgccatgcacccagggctgggcgagacctgtcttgcaggtgttcaaacaacttttgtcagcctcagtgtcagggacttttgttgcgtagagcagtcaccgaatcctatggtgagaagagaaatcgttggagatgggggtgcaggggtggaagctcttatttcagaagacctgttgtgaggtaagactcagaccctcagcttctatccggccacagagtttgggaccagcctttcgatgtcttttggaagatgcacatggaatgcttagcctttgctcttccctggaacctggcttaggctttgcacctatcccaccatgtggttggggtgagtgaggacaacttcttttcctccagaacatggtttctccatctcagccctattgacattttgggctggataactcgctgttttgggaggctgtcctgtgtgccccgtaggatgtcctgcagcctcccgtgcctctgcctgctaggagccagtagcgccccctcccccacagacaaaaatgtctccagatattggcagatgcttcctaaagggcaaactacccttgctgtaggtaatacttgctttgaagtactggtgtggatggcctatgccctggcagtcttactaggtgggactggctgtcctctcattctcatgggattggcctcatgctggtagctgacttcctccc

SEQ ID NO: 392166 - DNA, 376 bp, Homo sapiens
gaaagtccacatggccaccaagtgcccaggggtgtgcctaggcatggagtggggtaaacctttgctccgagttctatgcatggtagtggggagtggcctaaactaatccaagagagtgggcactctggatgactggagacctgcgtgggcgtggagtgtggagactgcactagatctctgcatagaaagggtgggacatctcaggataagaagtgctccaaatgcctgaagatatgcctgggggtggagtggagagggccctattacaccaaggtctctgctcaggaaaggaggactcaggctgttaatccaggtgagtggatgctatgaaattactggagatatgcctgggggtgagcaaagagggccccctgca

SEQ ID NO: 392167 - DNA, 339 bp, Homo sapiens
gatcgctcttgtgtttttgcactattaattaacttcaagtgcaattttggcaggcaggccaagggtctcaacaggctatttggaatgagttctcttttaaggccttcaacgtagtgagacattttcaaatcaaaaagtacagcaggagccagcctttattttgtctgtgtacacaataaaatattccgcttctataggcagatcagctggtcttagtcacaaataaattgtgcatattattactgtgcttaataggcaaaaccctaaactatagaaatttttgctattcccactgctttcttatgcactagaaaaaggcatgaatttgatgtctttttt

SEQ ID NO: 392168 - DNA, 264 bp, Homo sapiens
tgggaaattgaggctgcagtgagtggtgttcatgccactgcactccagcctgggcaacagagcaagaccatgtctcaaaaaaaaaaaaaagtgttatatgggctgagggcctgggacctaggaaagctgagtgctggccctggggtgctgttctttcttgcctgaagggatgtccaccctcaggtctcacctccttctctgctagtgtaggggtagcccccagagtttctctcaactgtcttctctgatcactttgagatcttc

SEQ ID NO: 392169 - DNA, 486 bp, Homo sapiens
atctcaacatgacaccaccaataacatgtaaatgacacaggctttgattgtgttgtctcccatatgctttaaaatttttttaatataattcctctgatagtatttaggatttaaacaaggactagggtgaagcaaaaattatttctagacactaaacttataaccatactcattaggatcctggcctctatggcacttcccacactgtgctacaaagaaccacgaatatttccaggtgctcgttccaagagaaaaaaatgaacacatcaattcactccatatcaaatctctactgtaaagacctaattttccacattcgatgattttaaaatcagtatgtgttctacaaaacatgttaatatggtaggggagttttcttccttcaaaggtaatttcttattaaattaggagtggaccttttaatatatatgaatgtaggtatgtatacatatatacataccctataagatatatctccctgtaaca

SEQ ID NO: 392170 - DNA, 478 bp, Homo sapiens
ataagttatacatgtttacatatcacattagccattgaatactaagttgtttcatgtaaagaccagtggtcactatacacagagcgaaagatttcatttataggtttttatatggtccttcttgtagtgcccaccttgtaccttattttcctggattaaaaaacatacatatcacattattcttttctctgttcctgtttagagaccctgttgtattttcattttttccccctctctgggatttgctgctggcactcaagttcctgaaagaagcattctctcatagtctcaaaagagtcagaaagaacctcatttttcaggtgtagaaactgaggcccaaaaaggtcaagcagctggtcacggctagttaatagcagccagcgtctcttgcctttttcgtccgcttgctgctttctggtttttatcttcttacccatgtgagttccagcaccacctgctccccccaccaccaaaaaaa

SEQ ID NO: 392171 - DNA, 356 bp, Homo sapiens
taaaaaagaacctgacaaaattcaacaaccttgaataatacaataaaataactcaataaactaaggatagagggtaactaccctaacataataaaagccatatatgaaaaattcacagctcacgtcatattcaatggtgaaagactgaaagctctgtctccaatatcagaaacaagacaattatgcccacttttgccatttctattcaacacagtcctggaagcttaagccagcactattaggcaagaaaaatcagtaaaaggctacacactgaaagaaagaggtaaaattatctccgtctgcagacataatcttaagtgtagaatgctttaaagatttcaccaattattattttt

SEQ ID NO: 392172 - DNA, 1063 bp, Homo sapiens
ggattcatttatttgagcacaggacagaggaagttgccctgaagcaactgattgtcattgatattcagggctcgctgtcaaccaggaccttccaggaactggctctgggccaagagcagtagaaatcactgggtggtccgcacagctcgcgggcatctaacctgcttcaaggctcagggctaaaagggagccagggcccttcctggaggcgggaacccaagtgggaggcagagcgcctgggcccgctcctcgatctgctgagtgacgaccctgtacaagtcatttctcttccgagagcttcagtttcctcacgtgccaagcggacgggttggaagttggtctttgccagctctgacaccttgtaagttttgagtcttgctgggaatccagggcggggctcacgaggaaaatcttggaaggggatttcatggctggatctcttccactcaagctcagtgccctaatttgacgccttaatagtagacgcaggcttttccattttccaggagccccctgacgcggccgcttcctcctacgtctccttcctcttcctctagcaggggcaaagtctccacatctccctctttctcttcctcctttgcaagctccctgcattcccgcgtctcctcctcttcctcccaggaaatgcaatgccctcagtgcgcccaccttttggcaaagccactgccggctgcgggtttcccctcccccgccaggcgagctctgcgcggcggcttcgcgggcacacgccttcccataccttacatggacaaatgcgtgcaggcaaagtcaggaattcaggcccctgacgtcagcctccagcgctcagggcaccgcacgggagaccaaggggagggggtggggacggtggggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtaagggctggctgcacggcccggggcgcggggcgtggggcgct

SEQ ID NO: 392173 - DNA, 304 bp, Homo sapiens
aaacttgagctctctctgtggggggcaggggatagtcctgttttgcaaacctcccttagtgtgagatctcccctaaatagtggcattcctggaccctgtcatttatttactatattccaaaataagacaaccatttatctggaggcaatctccaacttaatcacttataatatctctggactggctcttttccctgactccagactagagcattcagccacctttcttgtcatccctgcttggaagtttactttgaacatgccaaagctaaaatgtcctgtcttcccccacagagaaacctgct

SEQ ID NO: 392174 - DNA, 786 bp, Homo sapiens
gaagtctgacattttggtgtgctctaggcatagggtgtctacctgaagagtccccagtaaaaatcttgggcactgaggctctgaggctcttcccttgcaaacagcacttcatgtgtgctggcaggatgtgtagctggggaagcaagtgcattctgtgtgactttcctgggtgggggcttgcatctgggttcctctggacttcacccccatgcaccttttccctctgctatttgtgcttcatatccttttgctgaaataaatcatagccatgagcatgactgtacgctgtgtcctgtgagtcctcctagtgactcactgggggtggtcttggtgacccctcacataccttccaaagctgttctgcctcttgaattttcctgcctcctcaggtctttctcttcaccccagtacaacccagtatccaaagtcagcaactcagaattgtctttgattcttcccttgactcaggtaccaacatcctattgattttgtctcagaagtgtcctcttgggcccaggcccctggtggcctttcctgttggcccagtctgggccctcagcacctcatcttcacactccctgcaatagcttctctgtctggtgtttctgcctccgttctccattccagcccgtctttgatgtaaccattgtttagtccaaaacctaggttgagttgacattgcccatgaaatagaatacagatgcatcgggtcggcggcttcatctggccacggtgcaggaaggcagggagaacccggatttgagtggtcagctccaccagtcactg

SEQ ID NO: 392175 - DNA, 615 bp, Homo sapiens
aaaaagatattaagttatagttgcagattacgttaaactaagtgaggtttcaagatataacatatacaggatagtgttagagcttttaagatagttttgggaagactgggagagaggattgaggtcactctgacagtcaattgtgaaagttactgacatacaaaattgtatgtaacagtcttaaatcaatacaggtttgatagactcatattttctttgtgcagagatggtgtaattcctaggctcatacctggattgtaccactcatggttttcaggatctgccagatagttcgatttgttttcctgttaagaattagaattaggccaagtatggtggctcacacctgtaatcctagcaatttgggaggctgaggtgggtggatcctttgagcctaggagtttgagaccagcctgggcaacacgctgtagaaaccccatctctataaaataaaaaaacaaaaactagctgggtgtggtggcacatgcctgtagtcccagctacttgggaggctcagatgggaagatcacttgagcccgcggaggtcaaggctgcagtgagctatgattgtgtcattgcactccagcctgggggatagaacaagaccctgtctcc

SEQ ID NO: 392176 - DNA, 203 bp, Homo sapiens
ggaaaggggcagtgagggcagacagagctgtgtctactacatgccaaggccagtgcatcccccaactctatggcatttctcccatcgagacacgaggtctttgtcccttcctctgcaatccaggctgacctagtgactcatttgagaacaagagaatgcagtggaaatgatggtgtgcgactccagagctgggttagaaaagg

SEQ ID NO: 392177 - DNA, 929 bp, Homo sapiens
acggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtcgcgatctcctgacctcgtgatccgcccgcctcggcctcccaaagtgctgggattacaggcgtgagccaccgcgcccggccgaaagcccctcttatgctcagtcacccagaggaagggtaggcattgatgggcagttcaggtaggaactggtcttgagataggttaagatgtgatagtgagaggagggccctgccaatgtataggaaggagaaaactaacttcctgatttgcacctcccagtctgtaggccactggcctccaatttttggcaaattggagatcttccccattcatagagatattcgtaaatccatcctgcacatcttcgctccagccaaccactagcccctgtacacacagttgctctgtattccccacccttttggcagctacatttcagagtgatgactggagctaggcctactcttaacattgtcattatttttcacaagcaagtcagcccaggtcaccagcttcttaaaaatgtatgcttgtcattgctaggaacagtcctcatgtgatttttcagtctgtccctctgccttcagggaggttatgtaaactccagtctagcacagctgccttcatatcatgactggctataaatggacttccatagtaagttgtgtctttatattcagatacactaaatttatgaatgtcatctctgctgttttacttcagcttgtcattcttaacattttcttgattcaggtgttttcccactatac

SEQ ID NO: 392178 - DNA, 535 bp, Homo sapiens
gcgaagtccctgctagactaacttatctcgtaatgtgctttctatagaaaagcacattttcagtaactaaatcagaaatgttgctttgcatgaaattgacaatttcttaatccaccctgatagcccagtcttcgggcctggaaggtactgtggccttgaatattcatcccttgcaatgaaaacattgctaaccagcatgcttaggttatggtttaggctttaacatggcttatgtcataaccataaaaagacttgaagaaaaggaataaacaggatcacaggtggttcccatatggcctgtggctcaattgattgttcccacggtatctggtaaggcagtaatcggagatttaggagcacatgttagacttcagggacatttctttgccttctaaaatggctgctttcaaaatcaccctcaggtttagtactaccccaagcaactagaatccagataaaaggacccttctatgaaatgattcttcatttgttttgtagggcatccatatttcacaggactaatcacaatgtggat

SEQ ID NO: 392179 - DNA, 113 bp, Homo sapiens
cttagcctcttagagtgctaggattataggtgtgaaccaccatgatggaccataattttttaatggacaacaaaccagtgaagaaaaattttgaaagaaatatcatccataat

SEQ ID NO: 392180 - DNA, 425 bp, Homo sapiens
ccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacc

SEQ ID NO: 392181 - DNA, 331 bp, Homo sapiens
cagacttgtaaatgaatgtttgtaggactttctttgtaatagacaaaatagtcaaaaactggaagcaatccacgcagccatcaaccggtaaatagatagaacagacggtggcatatccatgcagtggagtactactgggtgaaaaaaagaacagtgatacacactacagcatagagaaatctcaaaataattacgcagagtgaaagaagccagatgaaaaagaggaattaccatacagtcccatttgtatatatctcgggagaatgcagactaagctgcagtggcagaaagcaggtcagttattgcctagtggggacagaacgagatgtaa

SEQ ID NO: 392182 - DNA, 344 bp, Homo sapiens
ttttattttttaaaagaggaagaaatatcaatgaactgtttggtctaggaacaaactttttatcaggctcttaccggaaatgacgggtgggtcatgctcagttggaacctcagtccctcctaccctgaggcaaaacctctcaaggcacctgttctagcccctgcagggtgcctggccctcaatgattggtggaaggatagagggacaggaggtccaccctgtccaacagcttcattttgcagctaggcaaactgagttccagagaaaggaatcacggtcccatgtttggaaatggtcaaaatggggcttaaaccccagaaagtagtgctacttccactgtgctg

SEQ ID NO: 392183 - DNA, 241 bp, Homo sapiens
actgtggagcatggaaagaccattggccttggagtcacaccctcctgggccacactcacttgccacaggcccttaagaggtgctgcctcctctccaagcctctgtggttactgagcaaagtgctgtgcactgcagtgtatcttcccgtttaatcctcgcaacagccctatggtatagctaccatcattatgattcccattttgcagatgagaaaactgaagggtaaagaggtgaagaaatt

SEQ ID NO: 392184 - DNA, 406 bp, Homo sapiens
acatcagtctcttgatcaaaatctttcgtggcgtcctgttgcttactactgagctgtgtgaagaggtgacctagctgccccagtctctcattgttgcctccgggcgtgggcctgtgtgttgctgtccttgttcctgagtgggtcctgggctttcctctctcagtgcttttctttcttttttagggggatcggggagacagaatctcactctgtcacccacccaggctggagtacagtgacgtgatctccgttcactgcaaactctgcctcacgggcttaagcagccctcctgccttagcctcttgagtagctgggaccacagaaatgcgccaccacgccctgctaatttttgtatttttagtagagacatggtttcaccatgttgcccaggctagtcttgaactcc

SEQ ID NO: 392185 - DNA, 422 bp, Homo sapiens
ggggcaacacagtctcctgcctaagcactgtgggggggtgtgagccccgtgagatccctgctctgtccatctccaggctgtggttggcctcagcagcctctgcatcccttctgctttgcctagagggagactgcagggaaaaagagggaaagaggaagtgggaaagaagtccagaccatgttagatttccaggtgcgtgggcttgtgttcacaatggggaccctggctctttcattcacagcctctgaaggcctgacatatattcaccacatggctatgggatccacctagaaaggggaagtcaggtgatgtcttagaaaggggaggcactgagaagaaaggtgagacagctggagcaggtcagagcacttaggcactgcctttctggacatgtggccagggatcgaccaggacccttgtga

SEQ ID NO: 392186 - DNA, 156 bp, Homo sapiens
tggagcaggggctggaaagcaagtttgagatgagatcatgaaagatcattcattcaaatacaaaaaaatctgaacctggtctgtggatactgttgtgaaaaagaaatcgagtaagatttgtttagaattacacaacaggaagataataatctccag

SEQ ID NO: 392187 - DNA, 441 bp, Homo sapiens
aaccacagagagagagagtcaggcagggggaagagacagacagaggaaaagaaagagagagagagagacagaggcagagacaaagaaaggagcagagagagaaacaaaaggagagagagggagagaaagacacaaaagaaaaacaaaaagagaagcacacagagaccaaagaagaaacaaagacacgaaaacaggaggagaaatggagagagtgggagaaaatgcagaatataagagacagcccaggtggcagaggcccaaagttcctgggaaaggcagtgctgttctagaccaaactctgaccaggctggtgagtgggtgggaggccagttggacctgggactaaacacaggcaggcccactgcaccccacagccacgctatgtcacttcctctcctccgggccctgcagactccatgccagggcaggctcatgagataa

SEQ ID NO: 392188 - DNA, 420 bp, Homo sapiens
ggggaggaaggtatagataaagtaagagtcagtctggggctttgtcaaggcaaataaatgttaggttattgctggcttgacataattttcttctggagatcatgtcttaaaagtagactgctgtaagccattttctttaatgaccatgtcctatattctggatacatgtgtatgcttgtcttttgctagttagttactagtggaaactagtgaataggtaaaagcaacatgaaatatagcacggttttttgttagacacaaagaaatagagcaaaaaagtggaaacattgaaaattacttaaaacttactgtttttttgttggcagtattatagtcttttttcttattaattttattttctgtgttttataaattttctactgtagtcttctctaattcctccatttctagagtgacaat

SEQ ID NO: 392189 - DNA, 673 bp, Homo sapiens
tgagccacctcgcccagcctgttctatgtgtttttaatacttaggaagtgttgatacatataattttctggccttaacagagatggttagtagctattcataggtctgactgtaaattaaataatttttatttatttatttactcttttgagatagttttgctcttgttgcccaggctggagtgcagtggcacaatctcggcttactgcagcctccacctcctgggttcaagcgattctcctacttcagcctctcaagtagctggaattaacaggcatgtgccaccacacctggctaatttttgtattttagtagagactgggtttgaactcctgaccacaggtgatccgcccacctcagcctcccaaagtgcaaggattacaggtgtgagccaccgtgcctggcctaataatttttatttctttaatattgccactaggaacaattttctgtgacatttttgtagctctgtagttaaactaacttggaatttctttacagagcttagaatttacaatactgttagtctctttgagttgtattagtagaaaggaaaggtgacattaaatactgacaagcaaaaaatataaagtaattgctctttggcagctttagtcatgcctcctatatctgtctcattttgccttggttcatgccctcgtcttttctttct

SEQ ID NO: 392190 - DNA, 685 bp, Homo sapiens
gtagctgggactacaggtgtgcaccatctcacccagctaattgttttttttgtttgttttgtagagatggggtctcgctatgttgtctaggctggtcttgaactcctgagctgaagcagtgttcctgccttggcctcgcaaagtgctgggattgtaggcatgagccacgatacccatccccagtattccttttgatataaattaactgttacagaaccatagcattttaaagttggaagtttcctcagggaccattttttccaacaacctcattttatacaggaggaggacacaggcccaaagataagaatttgcaagctcaaagtgtcatggccagagaatgccagaactgggactagaattcaacctgtcatatgggatgtaagacatgccatttgccctcagaatcatgcagttcatttaatgagttttgagccttggtacatgcatagaactgtgagagatgctgagacagaggaagcaaattcaggtcctctttggggtggtttggtctaagagagtttacacttggacataaacacatgtggttcagggtggagattggaagagagaatgatggcatccccaaccaggggtactcaggaagggctgcagtaggaggcagtgttggtctttttgatagagatgtcagagaaggctttgggaagagctcccaaagatctca

SEQ ID NO: 392191 - DNA, 703 bp, Homo sapiens
ctctaatttgaaactaaaacatcttatttaattttaaaaaatgtcagttttggctagtctttaaaaacattcagcatgtaccaatatggtataagcagtatttttgtttctccatcagtttcaactaaagataatgcagttaaaaagccatattattgtcttccagtgtatgcatgaaattaagttaaaagaagtagttctaaagcaagactcagaacttgataggtaaaatgagatgtccctatctaacatcctatttcaagaggaaagaaatattttaaatcaaatatctcattctatttgtagaaaagtacatttagctatgtattctgctactaactcaattctaaaagttttcatcaaaacagtctttaaacataacatttgcttaaaatttggttctcccgtcaaagagacagtaggtggctgttacctttacttcaaattttactaaattttataaaaacctactatttttattaatataattcacacagcattcgaatgtttgactttttttcagacttcttaggaaaggcagcattttacttcattcattaattgcaccatttacgtcctgattgctgtgcatgtggaatatattgaaagataatattaaagtgtaagttttattaaatgttaatttgttttttatttcaataacaaatgagcaatttataataaaaacagttttccacctttt

SEQ ID NO: 392192 - DNA, 163 bp, Homo sapiens
gctttttccatgtgtcactctgctaaatgcattatgggcttcatttcatttaatctcccaaaaccccgtgacgcagttactactattattatctccatttaatagctgaaaaaaactgggacactgagaggttaaaatactggcccaaggttaccaagcaagt

SEQ ID NO: 392193 - DNA, 500 bp, Homo sapiens
ggacggcgactaaacgaggaaatcagaatatgacagagagtagttctaaaacatcatactttagtaacttgtgacgttaactacttcatagttgaattctttggaacattgatttttaaactttaatttctccctttgtaatgagatttatattcaaatatagaactgtttatagtattttcatttcacttctgcaacagatgggctgtcatttcagcttggtacagaacctctgaagttggaaatgtggttacaggtaaatggggatgggaaatagaatacagattgactttagatgcagagtagctttggtattaatttcataattgtgtatttctgtcctgtttggagctttcagaggataaaataaacacagccaagggaggatgcccaaagcagcagtagtgggctctgagggagcggcctcatggagttggaggtagtcctgccctgacagatgttaatctcctcgcactccaggtggcagccatacagaggga

SEQ ID NO: 392194 - DNA, 615 bp, Homo sapiens
catctcagctcggacccacaccacctgagtccccctttgtcctcctttctagcccaaagttttcctgtcccaactctgtctttaatgagaaaaaatgttccgtgcaactttgccccaaactgactcctacttctgaaaacaaaacaaaacaattagctaggaaaattgagacgcataccacttttcttctaactggccagtgtttcttgttcccgggtgaatccagagcagagtatgtctgctcctaggcacatagttgcaaagagtgaccaacatgcagcaaagattgacagtggtttcaaacgtagtgactcgtccacagtttctctttttcttgacttttcagcgtgtaatcaaaactactcagaaaacatatttcagtattttactgcatttgttaaaggatttgggacactacaacaggaaggcactctcatggcaagcaatgatggctggcagtttaactagatcgttactgctgctgtttctgtgatgacaacctccacttctgtgttcttagcagttgtgtagaaatagtcattacagcgtattgagctctttactatatgctcagcccttttatggatggtcttactaatcctcacaaaactccaa

SEQ ID NO: 392195 - DNA, 449 bp, Homo sapiens
atgctgcggaaaaaggtgctgtgtgggtctccctaggctcaactctaacagcatttgcgctttggccactaaagcacaaaatgcaaaccactagcctctcagcgcgggaaatggagcaagggcttaaaaatccggagatctcagatcaagttgaggcatccctgactcactggatgacctggggcaagtcaattcacctgtctgagcctcaggctcctgtgcacgtggagtgtgatgagtcgtggagtgtggtgagtcagggtttctctaaactctctgcctctgacatccagggctcctgtgcccacatactggaggagatacacatcatgaattggtttgagcttccctctgcacattgaatttcaggcctacatgactggaacccaaatgaggagggaatcttcagaaaccaagaacagtgctttacaggagaatctacaaaagtc

SEQ ID NO: 392196 - DNA, 725 bp, Homo sapiens
gagcaagtagaatgagtttacaaccatcacgtagactaacctcttatacaggtggaaaaatctaagaccttgagagcctgggtgacttccagtagcagagtcaggattaaaatcctggtctccttgtttgttccttcagctaagatgaatgaacaatattatgcagtttgcacactgcctcccaataaccaggctgtctcaaataaccaactaacacggtttctctgagaagcttgtatatttaccccttttgtgcttagatacatttgagaagtgatggttactaccttaatagtcatgtatgcaaaaccctatgcctgtagtcaattcattcctacctcattcaccatatatttactgagcgcccaatgcttgttctggataccgtggtaagcaaagacagtccctgttctcgtggagcttccactgtattctaatgtacctgactgcagagggccttggagatctttctcagccaaatatagtatttttctttccttggctggaccaaaggtgaaggtagataatagaatgatgggtgttactcccagcactaagagtacctaacatttatcttactgtgtatgactaatttcacatgactctgtgagatgaggcaggcctattagcctgatttatagatgaagaaacaggattagagagcaaacatagtgttatggttgagagcatggactctggcatcaggcagcctagatttgaatacc

SEQ ID NO: 392197 - DNA, 541 bp, Homo sapiens
catgcagtctcagaaagggccattgcagcacctggcgatttttttttccaggatggagaaaagttttcttgtcaggctacttcctgataggttcctgcagctgctttgatctaacttcctcttttccccactggacaaaaccaaaacaaagcaaaacaagtccaaaaacaaaagagaagtggggataggaccagccacgtgtgtacccttgggcggttggtacatgctcagggcatgagcccaaacttgctgtgacaagtatggtcccaggctgtgccttttagaacagtgtcctccaaagtactagtgaagtggtactgagatttccaaagactgtctttgcagtgcaggatttctgattctgacagaaaccaaggggagaactcactttttctatttaaaaaattatcagtaataaagcactcaggtcttcgaccactcttgcaaatactgttgtttttctctagctgagtctaggaaggaatacgagtttatagtgcagtgccagtaaggttggaattttctgtgataggggagtaat

SEQ ID NO: 392198 - DNA, 441 bp, Homo sapiens
aactctgggaaaatgcatgttataatggttgtcttatgcctgggagtccctgttctcagacatgacacacaaaacgtacaacaacctgccactggctggtatctgtccctagctattagaaatccagccgcaacaaacctccagccttgccagtctctggatgagctttacaagctaagttctgagccaattacagtatccttagtttattttttgtaggacccaccaaatatttatgggcttcccaggaaagttcagtcaacaattttagggtagctataatctatgtgtaacaactactcttcaacatgatttgtttcctctcttagtctataaagaggattttttgaaaggagaaaagttttgtttgaattttctcagaaactccaagttctttaaattggatatttggcaaatctttttccccagagttatccatgt

SEQ ID NO: 392199 - DNA, 379 bp, Homo sapiens
tagaatgaacagaatgaatacacagttcttaaaggggacatcctattttgtctttaaatttttttccttgctctacccctttgttagaatgtttgatcagattcagtttgggatttacatcttttaggaaattttgttttttaatatagattctcgctctgtcacccaggctggagtgtggtgtcatgatcctggcttacagcatccttgaactcctgtgctcaggggattccccccgcttctgcctcttgagtggcttgaattacaggttcatgacaccatgtccgtttattttttgtttgtttgttttaaacttttcttgaagagatggagcctcactttgctcaggctggcctttttttttttttttttttttttt

SEQ ID NO: 392200 - DNA, 332 bp, Homo sapiens
agagacgccccaactcagaatcaacctatggaaagaactatgaggacaagcagctaacaattatttaggtggtttcttacttcttacttcctcctgataccactttcctttatacttgtcccacctactcctggcagaaaaaaaaaaaaaaaaagcagccaacaaaaacttctgaatattctccctgtatcttcattacatacttcgtactttagaaaattgctctcagtaatatcttattataatggacaatttcaggatcaaaggtaccaactgtggctccatacccacccaacaggtccattaaccaattttttttttttttttttttt

SEQ ID NO: 392201 - DNA, 738 bp, Homo sapiens
atttatgtctgctttttctctgtttttaaatgtatattaaaataacagatatatagttttacaagccaaataatagtaaaaggctcattacaaagtataccaatttccttctttacccctccttactcttcaaaatccttctcccaaaaaaggagaaaccctttagcgtctcttctgctacttgcacatttccatatttcatattaatagttactatattgctgttattttttaattaaacaaaatgaggcattatttgttgacttcttcttatctttttataataaatgagaactgtcataccggcacttccactacttctctttctcatcatcctaatatatctattttaacaattttggttaaacaaatacactaaatgcctatgcaaaggatattgaaaattagtattataggatactatgattatggggggtttctcttcattttttgtgatgttaataatcgtcttggtttttatgttttttctttctttttaagcctcttgtctgaaatcatgatctctcctgccttccttgttctggctttggttctggattatggtcactcacccttaatgattgccaaatccaggtgaatcttccattcctgatcctttgtagatcgactttccttgtaactttctccttccttggtttccatgacatcactttcttacctttctggccactccttttcagttcgatgagtgagttctctacttgccctctttttttt

SEQ ID NO: 392202 - DNA, 446 bp, Homo sapiens
aaaaatattattgctccattggtaaatgtatttacccaaatctgttatttcagacaatagcccaacttagcactggcattaaatggaataaatctgttcttttactgatacggtgtctaatttagaaactttgctgtttttggcaatcacactgccttgatttaggtgggacagggatcagggattaaaatggctcttcccaagaggaaagtagacaagtttgacagcactgaaaacccaagacattgctgcatccggaaaatttatggttaagactggagaagtctggaaagttggacagctctgtcatttattaatttattggcctatgtaagatgtttttattttagaagactgatctacgacctctgaaaggatatgttttcaaactctgtattttttttctacgtgtaaaataaagatattctacatacaattttctaaaa

SEQ ID NO: 392203 - DNA, 832 bp, Homo sapiens
ggaaagaaagaaatcattgttcttgttttcagacaatatgatcttacatttaaaacaaaaatcctaaagactctgcaaaaaagctgttagaactgataaaagaattcagtcaagttgcaggatacaaaatcaccatacaaaaatcatttctatatgccaacattgaacaatctaaaaaacaatctcatttacaataactacaaataaaggaataaacttaaccaaagaactgaaagatctctacaatgaaaactataaaacgctgatgatagaaagtgaagaggacataaacaaatggaaaggttgcccatgctcatggattggaagaattagtattgtttaaatacccatactacacaaagtgatctatagaatcaatgcaatacctattataatatcaatgaaattcttcacagaaatagaaaaacaacctaaaatgaagatggaaccacaaaagacccagaatagccaaatgaatcctgagcaaaaaagagcaaagctgaagtcatcacatcacctgacttcaaaatatactacaaagcagcagtaactaaaataacatggtactggcatgaaaacagacacatagaccaatggaacaggatagaaaactcagaaataaatccacatttacagccagctcattttcaacaaatgtgccaagaatatacaatggggaaaggatccctcttcaatggatggtgctgggaaaactgaatatccatatgcagaagaatgaaagtagacccctatctctcaccatatacaaaaatcaaatcaaagtggattaaagacttaaatctaagacttcaaactatgaaactactagaag

SEQ ID NO: 392204 - DNA, 458 bp, Homo sapiens
ttggtagctatggaaagaaaattcagttagtagctgaatagcaaaggatcccattgaacaagtctcttatttctgggaataggccagtccaattgaacagttgtgtctcattttagaagatggcattgcagatgggctctcaaagctacgtctgtatatatgatgcaggcaaacagatctttaatatgaggcatttctatgtaaacagaagaaaaactaaggtcagtgtctggagcagtctacaaaccagtcctaggatctggagggcagtcagctaagaaggctaaaggcaaactgacagattttattggatcatagtttgtgtgtaaagtttgtccaaatataagttgttacaatgattgttttttaaagccaagttgactagcttcaacttgtaaagcttcaggaaaaaggcagttttaatttcaatgcatccaagtcagaaaaatgggaggaaa

SEQ ID NO: 392205 - DNA, 399 bp, Homo sapiens
cataattgccccaaagtggaaacaaaccaaatgtcctaaattatgttaaacccatcccgcagccttgtgctccgcccctggcggaggaagtgacatcacgggccccatgtgagcgcactgcaacacatgcagttgcctggtcagaaagagccggtgtcctaccagccgctgctgcccagaactgggcccttagggaagaggaggcaagaagatggtggacgaccccagtgctgtggacaggaacgtggagttctggaagatcaagaagctcattaagagcttggaggcgggctgggcgccgtggctcacgcctgtaatcccagcactttgaggccgaggcgggcagatcacctgaggtcaggagttcaagacctgcctggccaatatggtgaaaccctg

SEQ ID NO: 392206 - DNA, 321 bp, Homo sapiens
tgacccaattcagtcctcctccagcggccacaggtctttcctgtctctgcccttcaccttggggcttttcccaccccacatctgaaagccccctccaacttcacggacctggtgaaaacacaacctctgcgacctcagctgatctgcagacatacccccagctagtggggctgccaataggaataaacaccccattctccctactcctcaggtaaaacccaattttcaagtcatattttaaggtcacggtattggtaatttaagtttcaagtggcaaaccaaattgaaaacagtattaacaaaagggaatttatgaccccc

SEQ ID NO: 392207 - DNA, 325 bp, Homo sapiens
tgaattagcttttttaagtcaacaattaaagtgagactgccaacaaaagtaaacaggagctacatttaatttctgtttttcctttgagagccaaggaggccagcacttcaagtccaatgaaactgctaactagctaatggaaaatttttcttttcaaacataaatattaaggtttacaagtaaagataagggtttttttgttgacatagagcaccaaataagacttagccccttttagaaaatttgtggacattcaatatcatattgtctggacctcagtaggagtaaatcatcaaaggaagtcatttgcatttcaggaacccca

SEQ ID NO: 392208 - DNA, 491 bp, Homo sapiens
atttaaaacacattaaaaacatattgatgtgtaaggtaaatactgaccaaggaaactgtcaggccagtgtttttccaaatggcaatcaatctaaatgatgtcgagaatatgaagtcaaaactagcttagatatgaatgaggcatacagccttaaccatggacttgagaatcttgttttaatcactgttctcaataatattcttgctgatctgaagtcacatacccctttttatctattgtatggttttaagtaatgttgcaaattgactgaagttaacatgggacaccaaaacatttctactagctgacagaaattttgcaaaccattctcatttttatggctttagcaatagtgttcaaagatatgaactgagcattgaagcagtgctagagattgcattttctatttcaccacacagtctaacaagcagggtctgtcttgggaaaaatggacttaaagtattataagaaagacattttttcacagactc

SEQ ID NO: 392209 - DNA, 278 bp, Homo sapiens
gcagcttcaacatctctgcagacaccatcactgcagccacattccagttccacagaggaatgcagacaatcctcacaatccccagggcagggcaggaggtagagaggattatgaaatgcctgcttgttgaccaaaacctacctagggaatctcaccgaatccctcaacaacccagaacagtactattctgtttactccctttggctccatagggcccaacagaagattactgttctggattgctgaggcattcggagaggtgaccctctagaggcgac

SEQ ID NO: 392210 - DNA, 271 bp, Homo sapiens
caatgtgtgtgtagggatagcaatgtgtgtgtagggatggcagtgttgtgtcgtgttcctcacacttccctgctagctctgagcagggagtacggtgagagcaggaggagtgaacttgaagcccccagggcctgggtgtgagcccccagctctgctgctcactctaggcttcagtcaggacatttaaccccggtctcccatcagtagaacaagtgatttgttaccccaccaggcagctgtgggcttgacaggcagatggaagaggtcctca

SEQ ID NO: 392211 - DNA, 203 bp, Homo sapiens
gcccagctgacttctaggttcatgctgctgcaccctgtcagcaggtccatgccatctgacacagccagaactgtcatggtcctgctgttccacatctatgacgagctgcaggagtggggcaggactgaggatttagatttaccttgtgacagtgccaaaggggcaaatgtggtccttctgaggccctccacctgccaggacca

SEQ ID NO: 392212 - DNA, 353 bp, Homo sapiens
cccaggggaaggtgtctgtgctacagccatcctgtggagcaggcttatgggtcatcgtaactttcccaagctaaaaaaaaacacctaggacctgtgttcctaggacatctggaatgttctgggttttcatattagtaaaatcccatttgctcacagacttttcccaaatcagaagtgacgaggtctcaggacgtcctgaatgttgctgggtaagtaattaaaactccactttctccaagcgcacgtgaggacacacctgtgctccccaggactggaacagcatctacacagccaaagcagaagggcgtggcatagctggtttggtaagaaagagtttaagttaaactagggta

SEQ ID NO: 392213 - DNA, 461 bp, Homo sapiens
tctccccaatcaccaagaacaggttcttaggtgttgacatcaaccaggactccagtagcacacttcaagagtccccatccatgccaatgttagaagtaatcctaggattgtcagaatgttccagggctggagacaaatccttcgtgtgtgtttttggaaaacatgcagaggtttagttgaatgaagtcaattttactgggacactggaatttttccagaggaagcagggatcttcctggacatttggggcagctactgggaatgatgcttgcaggacagctaagcttatccagagatcaccatgtatttcagtctgacaaaagataaattgtcaccaaattttagttgctatgtgtagctatgttcctccaaattcataagacttgtgatctttgatcataaaaatcgtttatattggttagtttcagtaactcaaaggaaataaacaccttaaatcttgt

SEQ ID NO: 392214 - DNA, 273 bp, Homo sapiens
agcgatctgtgaggccaaagcacggtgcttcttccagagaagacatctaatgctcagttttctgttgtgctctgagatcagctgcaggagaggggactgtagtctgccccaccaatcctactctgttgaagttcacccaggaaaactgatcattcagaatcctggaggaaatggaaccagcagcatgagtggtggactgtgatgagacccaccttctcccagaggctgggggtgttaggtatgaactgtccttaactcaaaggagtccactta

SEQ ID NO: 392215 - DNA, 498 bp, Homo sapiens
ccatcaggggctcatggctgatagaacacagatgccaaggaacctaactcaggatgagatgctgccttgggacagagaacacttgtgattcaaccaaggtctttggggctggggtgagtcactaaagaaactgcggtaataggacaggtggcagttgggtttcctaggagaaggggtcctcagggagtagaagaggcaggaagtgagcctgcaaggatggaataatgaacagggctgtgggtaaaaaaggaagcaaaccatggtggactatggtagtgactcagagcctggaaaagagggtcaaatacctgctcatagggaccttgggcaaaaggaaatgagaactgactccagggcaggccaaatgcaaggaccaagatttctcaaaggaaactaggaagccgctaggccatgtcctttgggcctgcctgaaaacccaccaccaggcctcctcccactcactgcctgtggccgacaccataattaccaaggcaggta

SEQ ID NO: 392216 - DNA, 240 bp, Homo sapiens
cttcctccctcctcctctaccctaccccatttcccttcaacaaatatgaattaggcatctaggcactggggaagcaaaagcgactagaaacagataaaatccctccacgatgacatcatggagctcattgtctgatgaggtagaggtatgttcatcaaataaataaatgcaagactgcagccctcaggacactttatctgataggttcatggtgccagtgcatgtctcatggtgcaattt

SEQ ID NO: 392217 - DNA, 445 bp, Homo sapiens
gggcacgagggagggccctgggcagcaatgatccgatgcagtccatattaaacagcctagaacaacagcatgaagaagaaaaacgatctgcactgggaggccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaag

SEQ ID NO: 392218 - DNA, 241 bp, Homo sapiens
cttattcttgctgttcttcctgtctgcaatacacccacccacgtctctgcctcttgaaattctagtaatcctccaagtcctctctgaaccagcatctctgtcatgaaggcttttctttgtttctacaaccaaattttctccttgaatcttctttttcctatgcgcctctcctttggcatgtaatcttttcatgccttctagcaactgtgtacctgatgtattcccttatgacaatatatac

SEQ ID NO: 392219 - DNA, 221 bp, Homo sapiens
tcatgactaacactagcatgggtgacagagcaagatcctttctcaaaaaaagagagaaaaaaaaaaaaaagaccaggagatttgttcacatgtccaaatttgataataattctctagagctccagcccaaagctgtgcatagaaatataattcaagccacgtgggtaattaaaaaatgtctaaggctgggcgtggcagttcacacctgtaatcccagcact

SEQ ID NO: 392220 - DNA, 224 bp, Homo sapiens
tcaagagaaagacttgattgttcttcctctctttccttttcacatgcaacacgtggattgagtgagtgctgaaagcctcattacaatgctaccctatccttctccattttttcttttcacctctcccctcctgcccactttttccctttaaatattgaagccctttaaatcctctttggaaaaagtgctgactccagatcctcttgtggcttctgtctatttcc

SEQ ID NO: 392221 - DNA, 353 bp, Homo sapiens
gtagctaggattacaggtgccaaccaccacatccggctaattttttgtgtttttagtagagatggggtttcactatgttggccaggctggtcagctcctgacctcatgatccacctgccttggcctcccaaagtgttgggattgcaggtgtaagccaccgcgtccggccctgaagaactttttatgggctggtcatctacttgaaatcaatgaccaaatatagtcagtactttcatagtggcatttttctgcaagtcaaaatatgtaatgattcttcagtaatttaaataggaatttatagacagcacctattaagtatcagggcttgtgctcagttgctaatcaccaaacaa

SEQ ID NO: 392222 - DNA, 417 bp, Homo sapiens
tgtgcatgcactgcatgtgtgtgtggcacatagtcaaaaggccaagtcagaatattcacagtggccttctgtctgatagattgtggatgattttacttttcttcatatgtccttatatttatgtttccaacagtttctctgatttataatcaaataattaaagaaaatttattggatttagtgatagaaattattggtaaagaaagaggagctttggtaggtagaggatttcatggttgagaatgaatatcaggtgagtaggtagaagctgcagtgtgtggaatgccttttgcacaagttttgcattgaaattaaaaggaaagagaaggccaggcatggtggttcatgcctgtaatcccagctgtaatcccagcactttgagatatcagggaacctgctcccgatagtcatgtaggt

SEQ ID NO: 392223 - DNA, 296 bp, Homo sapiens
ttaaattttttttcttacctttcatcgttttcttgatatccactgggttttagcatctacaaatgattcttgcctgaatcagttattatggtagttgatggttttctaattccattattccttctatgtttgttaattttggcattcttctataaggaagagcttaccctttttccctattaattaattcatatattaatgcagacctatgcattcttacttcattaaatcataatcctttactatcattatgtattctgatgttcagactatcccagatttagccaataagatcc

SEQ ID NO: 392224 - DNA, 955 bp, Homo sapiens
aggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgatgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagcttatcaggcgcagggccccagacagcttcccagccggccctagagcccggcctgggccaatgatggagggcggccaccagcccagggcctgcccatccagaagggactccccagggcctgggggaggagacccttggaaaagtcctctcttcccagctcctgattctggatctgagattctcagatcacaggcccctgtgctccaggccgaggctgggccaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaaaaaaaaaaa

SEQ ID NO: 392225 - DNA, 229 bp, Homo sapiens
ctttagaataaaaaaggcttcagtattctcaaaaatcatttcctctcccgaggaaatacaccacagtaaaacagccttttccagtactgtaattgctggctttctgcttcaaaagaaaatcctcgaatatgattcaggttacaatttccatcagacttttctgagtagactataataattttgtgtttgattaataaaataattccagaaatgaaaagaaatagaattt

SEQ ID NO: 392226 - DNA, 375 bp, Homo sapiens
ccgccatatcctttatcttccatacttttttgttcttttctggatagtgtaggtaaatgtcccagaggctgaccaatggatggctttaagctgcctgcttgaccaaggcatcctatgtcaaataataaaaataataaaaatgaatagaaatttttgtcagtggtggaaggaataatgaaaactgcattggttttgaaagacaggtgagcactatgaatgccccagactctaccagtctgggagtacacgtaaggttgccttagtagatgaacttccagtccactgattgtgtggctcttatgtgcctgatgggaaacatttggcatcttctccaaggtccttctcccctgtgcctctcccctgtgctcgcagact

SEQ ID NO: 392227 - DNA, 357 bp, Homo sapiens
caagcgatccccctgcctcaaagtagctgggcgcgccaccatgcctagctgatttttgtgtttttggtagagacagagtttcaccatgttggccaggctggtctcgaactcctaacctcagatgatccacctgcctccgcctcccagagtgctgggattacaggtgtgagccactgtgccccgccaagatcaaaatttgaagcagggcttctactgaatgtatatcgcattaccaccattgtaaagtcacagagtttaagttggactgtcataggtctgtttcccagcttgtacatacaggggaaagaaggtgattaatgaaaaaccttaaacagcaggttttcgatggataggtgc

SEQ ID NO: 392228 - DNA, 384 bp, Homo sapiens
aagggcaatccatttcacacacacacacatacacacgccacacacacacacacacacacagacgtaaacaaatttgagacttgcaagattaagtaggggctagttaggcaagagtaagagtggagagagggtgtttcagagagaggaaatctaatatgcaaagacctgaggagcaagagagtttgcctcttaagctaaaaggacagtggcagcaggctggtcagtcgggggcacatgggtcaaaatgagttttgagaggcaggtggggctggcatcataccattgtctctcacctctgtgcctttatgcatactgttccttctccctggaatgccagcatcttacctgcctgatgcacaactcttcttgcagagaggagttctg

SEQ ID NO: 392229 - DNA, 271 bp, Homo sapiens
aatattgtgacctccactctatgactctgccacatctgtttctcctaaagaaccctggtaacctcctcctttgtgtagaaatgagcaagaaagcagagcaagacatgcaaagccctttgaggaacagcagggaaaccagaaggaccttcagtcacatcctagaggtgcaagaaacacaacttccactctcaaaattagattgaatttctatttcaagtccccatttggctggtagaaagacatctagccataattaatcagggcctcccta

SEQ ID NO: 392230 - DNA, 168 bp, Homo sapiens
ctgtttctgttttttcctcctcccagtttgttgaagcccatggttaactgagaaatgcaagtggtgcctaggtttttcagggttatgcctgtcacatccacactgccgcagtgaacaaagcctagaagcctgcggcaagggaagcgcctccattcaatggtggctggc

SEQ ID NO: 392231 - DNA, 357 bp, Homo sapiens
tccaagtagcgtgcatcagcaagatagcagaagcaggaagagatatggccaagagacacattccacctgaagactgagagggaggctgtccggtaccatgtaacagttgcgtcagactgggacacttcctttttacagaggactataaaacccctgccctgtccttacttggggctgatgccatttcaggcctcagcccacctgcaccgagatgctcattaaaacagtgtgttgctccacattgcctcatcttgtctgttggcacgctctcagggttcgaaccaatataagagccttgcaatccgcacctgcccaagctgatctgtcaacaaagaaaatactttcatgccgggcacg

SEQ ID NO: 392232 - DNA, 298 bp, Homo sapiens
  misc_feature (81)..(81): n is a, c, g, or t
  misc_feature (86)..(86): n is a, c, g, or t
  misc_feature (196)..(196): n is a, c, g, or t
  misc_feature (204)..(204): n is a, c, g, or t
  misc_feature (217)..(217): n is a, c, g, or t
aatttttcatcaagtcattttaagcgcgtattatttgcaagcgctgatccagcgggggtacagtagtgacggagacaaaanttccntgtccttacggggtttaaattacagcgggagagacagagaataacaaaaccttgaagctctgtaataaaaatgtcaggccgggcgcggtggctcacggttgtaatcccangcactttngggaggcccaggncggggggatcacctgaggtcaggagttcgagaccagcctggccaacacagtgaaacctcgtctctacgaaaaatacaaaaa

SEQ ID NO: 392233 - DNA, 259 bp, Homo sapiens
gtcgctgctgctgcagtcgacttaagatcccccttctgacctcaggtgatccgcctgcctcggcctcccaaagtgctgggattacaggcatgagccaccgcgcctggccaattgctgtagctttttagtgagttttgaaatcaggaagtgtgagaccttcagtctttcaagactgttttagctatgtggtgtcccttgatatggatttttctatttctttagaaaatgtcattgggattttgttaggcattgcattgaa

SEQ ID NO: 392234 - DNA, 626 bp, Homo sapiens
caccgtgcctggctgaaatattttaacctatctgagcttcagtttcctgcctataaaatgaaaataacaaaacacacctattaaacattgagataatgcatgtaagctacttggcacagtactgagcacatagtaaaagctcaaaaatcagtagtcaccatcatcgttactttttgacttgttctcatgtgttctttttgaaattcaaaatatccagctggcttgaagatagttgtcacgttttatagtcagctatcatagactgagctatgtcatatgtaatagtacagtgtgttgaaagagtaattattcagaagcattttcaggtaaccagtgacattgattttcagaactagtacggaggcttgagaggctcaggtgtaaaaggtaatttagtacttagagggggttgagtagtaacagaaagtagttgtcagaccacaggtataaacataggtgagggcacagaatcattgatttgccttgattttcacatattcaagaagaaagtaactttgtgaataaataatgcgttcataaaggtataaaactcaggaggttcaagtgtcccatccatcttaaccctcagcctcccacgactccatctgtagaggcaaccagtgttg

SEQ ID NO: 392235 - DNA, 368 bp, Homo sapiens
gacaagggacaggtgtggctaggacctcctaggattctgcatccaagatccagtctctaaagaggttttggatcattcatttcttcatttgattccttcatttgttatgtgagagctcctgagtatgtgtctctggctgggcctgtgctggtgcagggtgtgagtggggaaagaaaacaaggtcctctccttgatcctctcatgacagtaacatggacactttgggaaacacaggatttcaggttcagtgatgggggttaagatctgagggggaggcctggacattttttttgcactgactctgatggttgaggcaggtgatttagttctggagtacagactaatcagctgaccatttgctctcactc

SEQ ID NO: 392236 - DNA, 533 bp, Homo sapiens
aaatgataaataaaacagaaaccaacaaagaaaacaaataataaaacggcttatttaagccctagtaaatttaaatgtacataatctaaatacaccaattaaaaaacaataattggcagagagaataaaaaaataaaagctgcaaatatgaagtggcccttaaaaggagaaggggcctttagtggggagattataaaggcaggttaaaaacaaacacacacgaatctaatccagtctttgctctaacgtctaccttctattgtctctctggaaccaagctgagtatgcctgagtatctaaaattgttatttcaaataaggactcagactaaaacttgaacaacttatactctgctgcatcaattggtagttgctctaataaataaagattgaatgctccggctgttcaaataagacattaaagcactccactcaaaaacaattgattggttgacttgatatttgtgatggttaattttgccaacttgactgggttaagagaaacctggattcctaataaaatgttatatctga

SEQ ID NO: 392237 - DNA, 754 bp, Homo sapiens
ctcacaaatgccctgaatgtgggaaaagattccttcgtagttcagacctttatagacaccaacgacttcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaagtgtactcattgttctaaaagcttcagacagagagccggccttattatgcaccaggtcactcactttagaggacttatttaagaattgctaagggaaacaggtcttacacaaattgacactaactcaaaaaaaatcttaacctgcagcaggctgtttgtcttggaagcttttgtttgagcttataagaacatagacagctttttttttactagttttaaaacccatcttccaaggtatatgaattctagagtatttatctactcctgtgattttcttagatttgatttcttctgtctgcacaactcttctttttttaattacaatga

SEQ ID NO: 392238 - DNA, 700 bp, Homo sapiens
tggagttttgctcttgtgtcccaggctggagtgcagtggcgcgatctcagctcactgcaatctccacctcctgggttcaagtgattctcctgcctcagcctccctagtagctgggattacaggtgcctgccaccacgcctggctaatgttcatatttttattagagaaggggtttcaccatgttggctgggctggtcttgaactcctgaccttatgtgatccacccacttcagcctcccaaagtgctgggattacaggcatgagccaccacacccagcttctcttctagttttatgtttttaggtaactatttttcaattgataataaaaaactatgatgcatgaatagataagagaatgaaggtattgttattaaaaataaagtatctgtttttctgaattctgggcttattcagcttcttagagtacagactgctagagctaagtccaaattttattttcttttatgtatttcatatatgagaaaagattttcattcatgttcttatatttgacattcttaatggtcagtaaactttctgtaaagggccagatagtaaatattttatgctttgtgggccatatggtctctcttgcagctactcaactacgccatcatggcgtggaagctgccatagagactacggaagtgaattaacttgtctctgcttccgtaaaactttagaggaacagaaatttg

SEQ ID NO: 392239 - DNA, 211 bp, Homo sapiens
aattattcagtgaaggatgattttgctcctagttttggagtttgaacttctgccaggattgaattattttgaaatctgtctttttaaactttttcaaaataggtctctaaggaaaaccagcagaacattagcctgtgcagaaccatctgtctggggagcacactcttcattatgcttggcacatagatctccctgtggtgggatctttttc

SEQ ID NO: 392240 - DNA, 317 bp, Homo sapiens
gctgaggtgggtggatcacctgaggttgggagtttgagaccagcctggccaacatggagaaaccccatctctactaaaaatactaaaaaaaaaaaaaaaaaaggatctatcttctcctgccaataacggtgcccagagctatcctactaggtattgccacttgcccgcggcaagcgtgaagacaggctgtagggaagcatgtgactaagcaacacggcttcacacctacgttctcctccgggccagtaaagcaaagtgtgtgagtgtgcggtggtagcctgaccttaaacttcccacggcaaagatgcggaccctga

SEQ ID NO: 392241 - DNA, 498 bp, Homo sapiens
gagaacccctcacaagaggcatatgcatagtgaaaggagtgagggctgcaagttcatggatgcattattttctcgttttcgtttgtagggaaatacatgctctgtcattgacttgcaaggattttctttttattcttaattgcctccctaatcctttctccactcagctgtggtactcaatgcactcagattaaatgtgtgtgttcttctgggccaggaaggaatagatagcattgatgtggaccctcaactgtattacagaatagggtggtaaacactcaggagaaacattctccctggtaaagtgctaagcaattgttaaacagcattttaaagcatgaatgaacgtcttgcttgtacattccaaagttccacaaacaaaagaaaagttcttattctaaaggagcaggagatgaatcctgccgataatgttttttataatgtggctgtgaatattttttcccagagttggtaatcctaaatcacctcttacaagta

SEQ ID NO: 392242 - DNA, 306 bp, Homo sapiens
ttttcattaaattgtcttaatctctgatttgtttatttccgtattattacctaggaggcgccaagcaagaaatacattattacaaacaaaccttgcaaattgaggtttgcttaataaagggactatttacaaaagtggggacagagtgtggagaaaccatagggatggtgcagtaaccagggcctaggaacagcgagggacattagcacccctaagcctagaggggtaaggggaaaagcagatgctggcacatgaagatgaaaagggttttgtattccaaagaccacctggcagactctgtgacct

SEQ ID NO: 392243 - DNA, 189 bp, Homo sapiens
ccaaatctccaacttacttatgtacaaacttacataaagtattagcacaatcacatagtgatgttccttgagatgtttttaatgaacgtgcatcgcaacagcctgtaattccttcccatgaagtgcctcctcaaaggggacagtgatgacagctttactgttatcactgtgggttggactgtagcatta

SEQ ID NO: 392244 - DNA, 590 bp, Homo sapiens
ttaataaatgaagaaccacaaatacatcctatgaacagaatttcaattttagaatgaatcaataacacctttagactaccatcaagattgtgaaagtgataatttttggtacatgaatttaaagatcatctaaattaaaccaaaagtgtaaaagtaccttcattaaaatggagactacaacctataatagagaaattaactctagatccctaatgcttattactcctttcggatacatcattccatgacactggaaaatattagatctgatagggattttgcaggtagcggtaaaaccttatgtaagtatttttttaatccacccacgaaggattatgttgaattcccagacaagtataattttcatctgcatgtctaacatacctatagcaacattacttaatatatgagtatgtgaagtatattttattatagtagtagacaagcaaactgaatgtgtcccaggaaggggtcttttccattaacttttataaaggctttcatttcaaagtttcattaacatctgacaagcaagctgaaaaagctttgcttagagcttaggttaggggcaaaatgcattttggtagaac

SEQ ID NO: 392245 - DNA, 252 bp, Homo sapiens
cctgtaggggtgtgtgtggggggacctgaggaggggccccacagagctgcctgaccaggtgctgccctgggccctgcataatggcaggaggagggcccgcggtgctctcagcccccgagcagaagtcaccactggaaggaaacttgcctgccgtttccagcatcttgtccccgccgctgcgtgaccttggccgggcagtgtggtggcacttaaaattggaaagtgtgagcttcttccccacagccccaccct

SEQ ID NO: 392246 - DNA, 372 bp, Homo sapiens
tgccgtcatcacgtatatgatccgggtgtgtgtgtgggttggcacatatgtacatatttcacagattatcccattcaaagatgggaaggtggaagtgtctgtcctcaacaagtactgtggtttgcctggctgaaatgcaaggaaacccccaaaagcaccagagccctgcatttattcagctgaaaaaatgtgttttcttttttaaatcagagtctcctaagatagaagaacttagatggctcatccagtgctgggttgaatgataaaacccagacctttttggtgctgcgttttgattcatccctgaatgtgacaccctggtacttgggttcctgggtctggctttacaggatgtgacttcagtcaaggaaa

SEQ ID NO: 392247 - DNA, 295 bp, Homo sapiens
aaacaaaaacaaaaacaaacaaaaaaggtcacccagccaggagggaatcggagagagagcagaacctcaggtgtgaagagatcaattttcttccaagatagctaaggagggagtagaaaattgtgggatgatgggtagagaagaggaaggaacctctgaggaatcatttttgtctcaggcagcaaaactataagccttagacatcatctgcctcatctctctccattcctcaaatccagactccaatctgcctccagatcaggtagcccccaaaaagctgccaattttctccctt

SEQ ID NO: 392248 - DNA, 362 bp, Homo sapiens
gattactccagctcccaggtttagaacgggctgcaggcaggcagggcggcagatgcaaaggtcatccaggtgagagatgctttagactcacgcagcagcagcataggtaggcggagagcctgattcaagatgtattttaaaggtaaagtctctgggacttcctgaaggactggacacgaggcgtgaaaagcactgaggaatcaaggatgacttggaggtttccggcctgagcaaccagaaggctcaagttgccatgacgggaggctgaaagagcaagtggatctaggacgtgtcgagtctgagacgtctgatcgacatgaaagaggtgacattgagagggcaagtgcagccagcgctcaagc

SEQ ID NO: 392249 - DNA, 143 bp, Homo sapiens
tgtgtgtgtgtgtgtgtgtatctagattttacatagatacatattcatattttacataactataaaatcaggatatgagatttttattggacataatgactgcaaatatcttctctgtagcttttcttttcattctcttagtg

SEQ ID NO: 392250 - DNA, 371 bp, Homo sapiens
aaccctgggtgcatgcatgtggcaggaaagaggccctgcccctctcaggctccagcacccaagccctctcactgtctacctcccctgccatgcaacacacaaggccgtgcacagacgccaggacatacaccaggcagcaaccacggcctctcctcacagacccaacacacagcagcgagcgaagccatcccgcaacacatgcatgctcacacatgcgcgcacacacatgcacacacacgcacacccacacatgcacatacatgcacgctcacacacatgcacactcacaaacatgcacacatgtgcacacacgcacgctcacacatgcacgcacgcactcacacaatgctcacatgcatgcacacacatgc

SEQ ID NO: 392251 - DNA, 405 bp, Homo sapiens
agtcagcagtcaggttgaagattatggagtaggtctccctgcagctcccactcctgatgagctgggataacaaggttctaaatgtgttaaaggaaaaacacagaacaggctctgttgggtgctgtgggtagcagggccctctgtctccttggggataggccagacccttcctggcagactgcaggcctaggcgctcctgagtgtggcaagccaggcaccagggtcacctgcacagggagagctagcagcactgccaccaggagtcactgtcatgcagacaagcagttcctgagtaggtgaggtttctgaccgggttcctgagactcatggtcaggaaactgacctacccaatctgcctgtttgagtgctgccactagaaacaaaaaggtcctctctccttccttt

SEQ ID NO: 392252 - DNA, 680 bp, Homo sapiens
ttcgtctcggtcctgaaagaaggggttagatttgctataatagctaggtgttaagaaaggagaggtgttatctagatgaaaacaattaacagaaataaataaggcaggaggatgaactggcttgagggaaaaaggttttgttacttgcttcgttgatcacatgcaatgcttagcatgttgctgccacttagtaggtcctcagtaaatatttgcagtttgactatatatttgagtttattattaaatcagtcattgaactcccagatctacatggcctacttttagattagattagacaaattaaatagattataaacttcctaaaagggaaggacaatgatttctgtctttgattctgaccctacatgttcttcccaactgctttagtttgacgattttcacagctacaggagatgttaaaagaatgatacagcaagcgcccacccttcaccgtgattcctcagcaaaattacaccatgtttgctctgtctctctcttatctctatatgataattttgtggagtcatttgaaagtgagcattttgatgcttccgtgtgtttagctttgcacacattgaatctgaggtggcctgacggtggagctgaggctggaactggttttggtagtccacattagatttgaaagtttgggtgatgttaaagtgcacaagattgctgag

SEQ ID NO: 392253 - DNA, 362 bp, Homo sapiens
gcggccgcctactactactaaattcgcggccgcgtcgacaaaaagggcactattgggcagaagtgagtaaaagctgtgtctagagaggaagaaacattagtgggagaataaatagtaatagataaagcttgtgttcttcagtgtcaggctaagtctttaaattttattatgtagatgctggagaatcattaaaaaccttttgagtaggggctgtcattcagatagagttggctatctggatagagacagagtaaggattgagtggagcttggtaggaaccaggagaaatcgcttgaacccgggagacaggggttgcagtgaaccaagattgcgccactgcactccagcctgggtgacagagc

SEQ ID NO: 392254 - DNA, 352 bp, Homo sapiens
ggagcttggtaggaaccaggagacttggagattgctacagtagttaaggtggaaggtcaagagggtctggggtgtaagtggtggccttcaaagtggagaggaaagagaggtagaagacagtagaatccatagaacttagccactgatttcgatatggaggacttgaaaaggagtcgggttcttctgggtgttggggaagttggtggtgcattaacagaaataaataaggcaggaggatgaactggcttgagggaaaaaggttttgttacttgcttcgttgatcacatgcaatgcttagcatgttgctgccacttagtaggtcctcagtaaatatttgcagtttgactatata

SEQ ID NO: 392255 - DNA, 373 bp, Homo sapiens
cagcctcatagttcccaggagtgtgcagaggggctaaacacccgtctgtgttccagccagctgaagcacctgtctggtgcgagttctagacaggacagtggtgggatctcactcagttgctcctgtatggagtaatttgttggccatctgcctgttaagggcactgggaaaaagcagtgcagtgatccaaaggtctgctcacgtagcaaacatttgtgcacctgctgggtgctggggtcagatagtgtggccctcatgaggcagatgacacagacaggtgagctgtacagttaccttatggtgaggtgagagctgagatgggagaagtgcagggtgctggggcacacagagaaggggtccggggtcctgactc

SEQ ID NO: 392256 - DNA, 1687 bp, Homo sapiens
  misc_feature (156)..(156): n is a, c, g, or t
  misc_feature (158)..(158): n is a, c, g, or t
  misc_feature (209)..(209): n is a, c, g, or t
  misc_feature (549)..(549): n is a, c, g, or t
  misc_feature (1100)..(1101): n is a, c, g, or t
  misc_feature (1103)..(1103): n is a, c, g, or t
caggtgtcccaccgtgccagatacgctgcctaaactgcttccagcttctttttttttttttccccccttctgcaataagtctgtgatcagccacgggacagaggcgccagcagcctgcctgtgacaggcatcaggttagctggctcccactcgggntnggcgcgcccaggatataaatccgggcgcgggcccctgctgtggctcctctnccctgcacactcaggagagggagcttccttctaaagacctttcttttatctgaagccgcacagcccggcaggctgtgctgacttggtggaggcagcagcggcagagcagcctgagcagcagcctgagcaggaaacctgctggggtggggagggcaggtgtctgcagcccctgagaagaaggccctggtgggccccagaccctggcatcgtttcaggggaggtctctagccgccccagcctgcaccatgtgggccccaaggtgtcgccggttctggtctcgctgggagcaggtggcagcgctgctgctgctgctgctactgctcggggtgcccccgcgaanctggcgctgccgcccatccgctattcccacgccggcatctgccccaacgacatgaatcccaacctctgggtggacgcacagagcacctgcaggcgggagtgtgagacggaccaggagtgtgagacctatgagaagtgctgccccaacgtatgtgggaccaagagctgcgtggcggcccgctacatggacgtgaaagggaagaagggcccagtgggcatgcccaaggaggccacatgtgaccacttcatgtgtctgcagcagggctctgagtgtgacatctgggatggccagcccgtgtgtaagtgcaaagaccgctgtgagaaggagcccagctttacctgcgcctcggacggcctcacctactataaccgctgctacatggatgccgaggcctgctccaaaggcatcacactggccgttgtaacctgccgctatcacttcacctggcccaacaccagccccccaccacctgagaccaccatgcaccccaccacagcctccccagagacccctgagctggacatggcggcccctgcgctgctcaacaaccnncntgtgcaccagtcggtcaccatgggtgagacagtgagcttcctctgtgatgtggtgggccggccccggcctgagatcacctgggagaagcagttggaggatcgggagaatgtggtcatgcggcccaaccatgtgcgtggcaacgtggtggtcaccaacattgcccagctggtcatctataacgcccagctgcaggatgctgggatctacacctgcacggcccggaacgtggctggggtcctgagggctgatttcccgctgtcggtggtcaggggtcatcaggctgcagccacctcagagagcagccccaatggcacggctttcccggcggccgagtgcctgaagcccccagacagtgaggactgtggcgaagagcagacccgctggcacttcgatgcccaggccaacaactgcctgaccttcaccttcggccactgccaccgtaacctcaaccactttgagacctatgaggcctgcatgctggcctgcatgagcgggccgctggccgcgtgcagcctgcccgccctgcaggggccctgcaaagcctacgcgcctcgctgggcttacaacagccagacgggccagt

SEQ ID NO: 392257 - DNA, 327 bp, Homo sapiens
ctggctgtcctctaattcagttcccacactgtcttcccgacgctgtctcccacagcttgagggcttagtccgcaagactgccccctgtcacaccagtcacaagcccaagcctctggaacttctgatcaactggcttcaagttggggttcccatgaccccctctttgggttcgactaatttgctgaagcagctcacagaactcagggaacttacttatgtttataggtttattataaaggatattgcagaggatacaggtgaagagatgcacagggtgaagtatgggaaaacgggcatggagcttccatgccctccccgggggcatca

SEQ ID NO: 392258 - DNA, 205 bp, Homo sapiens
acccaaagttagtataataaaaacccagcctgtcttcttgttcataggctaaaacaaaatacgggacttataaaataaaattaaaatggaaaattgcaaatttggacaatctccaacatgtagctaaaagcattcaaagaacctgagaaaactgacaaaatacgaactaaaacaaacatacaatccttcgaataaatctagctat

SEQ ID NO: 392259 - DNA, 1537 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagtagagaaggggtttcaccatgttgcccaggctggtctcgaactcctgacctcaagtgatccacccacctcagcctcccaaagtgctgggattaccggcgtgagccaccacacctggcctcatctgtcttctcttccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 392260 - DNA, 179 bp, Homo sapiens
ggatttgctggtgcagtacaactaggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 392261 - DNA, 1156 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 392262 - DNA, 1264 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 392263 - DNA, 1399 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 392264 - DNA, 1696 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagagcccaaagtctttaatggtggcttgggcaggaagctgccagtcagttcagcccagcctctcttccccacagccgggctggcagacatgacggcagagctacagaagaagctggagaagaggcgggcactggagcactgattcggacacaccagggaccagcgggctagtcccagggcatggcccagcggccagattctttttcccaggattaaaactctgaccccaggaaaaacccaatgccgcgccatcacctcctccactctcctcctctcatccccatatctcgacactccccgtcgaggcgcattttctcgggcgtgtcacagacaaagcgggcgagacacgtacgccacgggcccattactgactcactccagtgcgctcgccgtagagccggagtatttgtgtacacaagcgcgggggctaacatatgctacgcgcggctcctccagatggtggggccagcatatcacctctcgcaagacgccgggtgtatcccgcggcttatcacggtaagtggtgaat

SEQ ID NO: 392265 - DNA, 1324 bp, Homo sapiens
gacacaggaaactcccctgaaacctgtttctcagcttcccggcccagctggggcacccactggaaggagaggccaggcggaagaccctggctccgtcatggcctctgccctgaggccaccccgtgtccccaagcctaagggtgtcctgccttcacactactatgagagctttctagagaagaaggggccctgtgaccgggattacaagaagttctgggcaggcctgcagggtctcaccatttatttctacaatagcaatcgggacttccagcacgtggagaagctcaacttgggagcatttgagaaactcacagatgagattccctggggaagctcacgtgaccctggcacccacttcagcctgattctccggaatcaggagatcaagttcaaggtagagaccttggagtgtcgggaaatgtggaaaggcttcatcttaacggtggtggagctccgtgtcccgaccgacttgaccctgcttcctgggcacctatacatgatgtctgaagtcttggccaaagaggaggcgcgccgtgcactggagacaccctcgtgcttcctgaaggtgagccggctggaggcacaactgctcctggagcgctaccccgagtgcgggaacctgctgctgcggcccagcggggacggcgccgacggcgtgtcggtcaccacgcggcagatgcacaacgggacgcacgtggtccggcattacaaggtgaagcgggagggccccaagtacgtgatcgatgtggaacagccgttctcttgcacctccctggacgccgtggtcaactatttcgtgtcgcataccaaaaaggcgctggtgccattcctgttagacgaggactacgagaaggtgctaggctacgtggaagccgataaggagaatggcgagaatgtgtgggtggcgccctccgctccgggcccaggtcctgcaccctgcacaggtggccccaagccgctgtcacctgcgtctagccaggacaagctgcccccactgcccccactaccgaaccaggaagagaactacgtgacccccattggagatggcccagctgttgactatgagaaccaagatgtggcttcctctagttggccagtcatcctgaagccaaagaagttgccaaagcctcctgccaagcttccaaagccacccgttggacccaagccagggctggcagacatgacggcagagctacagaagaagctggagaagaggcgggcactggagcactgattcggacacaccagggaccagcgggctagtcccagggcatggcccagcggccagattctttttcccaggattaaaactctgaccccagga

SEQ ID NO: 392266 - DNA, 584 bp, Homo sapiens
aatgtgagcccagctaagacagcagagccatgtcgccaacccttagtgacctcagaagtgagcccatctcagatcagcagagccactcagtgggcctggaggctcacgggaaagaattaatggttgtgtttgaagctattacatttgggggagttttgttacacagcaatagataactgatacagacatcccatggactatctctgagcatcacatactaaaaatgtgactgcaggagcagttaatcagagaagcagggtctcactgtaactcaaacagagacccccagctgtggctatggcctctccagaggagaagagtcatagtggttaagacacatagacagagcctgaaggcaaggttcactgtgtggcagccaatctccaaaggtggccccagggaaccatgcctcctggtgtttccacccttgtttagtcccctcccacacggaatctggattggccctaaccctcacattaaccaacagaatgcagtgaagtgccactgtgccagttccgggcctgagacttaacaagacccagcagctttggcctgtgcgttctcaggagactgctgccacctaa

SEQ ID NO: 392267 - DNA, 729 bp, Homo sapiens
atgagctcctacttcgtcaaccccctgttctccaaatacaaagccggcgagtccctggaaccggcctattacgactgccggttccctcagagcgtgggcaggagccatgcgctggtgtacgggcccggcggctcggcgcccggcttccagcacgcttcgcaccacgttcaagacttcttccaccacggcacctccggcatctccaactcaggctaccagcagaacccgtgctcgcttagctgccacggagacgcctccaaattctatggctacgaggcgctccccagacagtccctttatggggctcagcaagaggcgagcgtggtgcaatatcccgactgtaaatcctccgccaacactaacagtagcgaaggacaaggccacttaaatcaaaactcgtctcccagcctcatgtttccatggatgagaccccacgctccggggaggcgcagtggacggcaaacttacagccggtatcagaccttggaactagaaaaggagtttctctttaatccttatttgacacgaaaacgtcggattgaagtctctcatgccctgggactgaccgagagacaagtgaagatctggttccagaaccgaaggatgaagtggaaaaaggagaacaacaaggataaactgccgggagcccgagatgaggagaaggtggaggaagaaggaaatgaggaagaggagaaagaagaggaggaaaaggaagaaaacaaggactaa

SEQ ID NO: 392268 - DNA, 303 bp, Homo sapiens
gacctgggtcttttgttgggggcagggcaccttgcccttgaacagtcccttccaccccagctagccacacagcatgtccccgggctcagtggaccggtttgttttcccctggcactggacacttgccctccaatcaggtcacaatggccagataagatagaggatctggcaccagcccagcctgcccctgggaattctgcaccccactggctataggcagaaagagtaaagccaagtcctcacattccaaacccagctccatcctgggacacactttccacgcttctggaattaaaggaacct

SEQ ID NO: 392269 - DNA, 509 bp, Homo sapiens
actggttgccaggttggcatgaacgatgacatcagagattccgaccttcctgattggagggaccggactccgtggtgcctggagatcagttggacaacagtatcttctcagagctgttctccactcctgacttctcctaggcttgagaattgccaaccggccatcttcgatggccggttgttggaggagatggacaacgagaagaggatccggctgctggcagtttgtcactggtacctgacgtgtgcctgtcgggggatgtgcggaactcatcggtagcaagggaccatagaagttttgcattgacaaagttggtatgggaaatctgtctgtgcagaagccatagttgcttgaagcgtctggatcttccagccttacaagagctaggaacagtggagagagaagctgctgtatgccattgaggagaccgagggctttggacaggagtaaccgaggacgcgctcccaggccctccagcgcacatgtagtcctgagtcctccctgcctga

SEQ ID NO: 392270 - DNA, 248 bp, Homo sapiens
cagatcacccatgtcctgggttcaagtggggcccagaaatacccccatggttggctcagccttcgcaggatcacacccagcagcagtgctcaccggagtggaggctgagggacaggcactgactgtggacactcacgcactgtgtgaccaacaggtggactggccagcagactgcctgacgcagatgaccgacagacagacagactgacggctgggtagaaggggggcatgttgatggcatgccggct

SEQ ID NO: 392271 - DNA, 278 bp, Homo sapiens
gctgggactacaagtgtacgacaacactgtgcctggattgttgagagttttagttattttcaaattgacacagttttattagttatcctttaataaacatggtattctaattgatgtaggacttcagccctaggggcattgccagagcgtttcaaagaggttgctaccggtactacaacaagtacatcaacgtgaagaaggggagcatctctgggtttaccatggtgctggcaggctagatgctcttcagctactgactttcctacaaggagctcaag

SEQ ID NO: 392272 - DNA, 323 bp, Homo sapiens
cagcttcactccttctctagagaccctgcctttgggtctcaggcctcgtctttttgctgcttctgcagaccttccctatcttctcgtcacccaggacactggacctgctttcctgctttgggtcttgcctgtcagacagcatcatgtatatgtatgtttcctatttatagattcatcgtatgtcaggtcttccccattagaatgtcaatttcaaaagtacaaaaatttttaatctgttttcttcatataatcattctaggcacctagaatattgcctaacacagagtaggaattcaataattatttgctgaatgtatgccatg

SEQ ID NO: 392273 - DNA, 499 bp, Homo sapiens
agcaaattccctcagtaactgggaaatttacagtatttttgtttccccaattttttaatatttagattacctgaaaaaagtaaaaacaagtctcaaacaaaaaaaggataccaatccatatatagcaatgattaaacattgattgtttgcaatattaagaaagtgcttcaaattataacatttaacaaaatgtctgttcttacatatttacctactatcttccttacacctaaaggtttatcttcatcttttatcaggatgagacagagaaatttgctaaacttgttccctaaaaaaatcaaacttttcctgagcctaagacacaccctcactgctcggactttagcaaaaaactctcactccttaagggctttcacctgcaggctttatcgtgggttgaaaaaggcattataatgctgttacttcattttatttatttatttatttattttgagatggagtctcgctttgtcgccgaggctggagtgcagtggtgcaa

SEQ ID NO: 392274 - DNA, 537 bp, Homo sapiens
cccacaaaccgatatcagaggctacctattaaaactctcccatatacctaacacatacacatgcacacacatacaaaatatatacatatcacacacttagagaatgacagatttcaggcaatggccaatagtcagtattgagtttttctaaccccagaatctggttgggctttatgatctaaaaaaatgtggtttagaaaagaggataattggtagagctgtagtttgaaaatatcaggtcaaagttgcaaacatacttatgatggaatcatttcatttttagttcctttcccagaaaagctgagagagcacactgttccagctgacttttttttccattaatagccgttctattcaacaaagagctgcccacatgccaggaaagtgctacagtccttctaagcttttaaaaatggggatcaagctacatgcagccagttggaatacttaagatctttatgccaagacacaataacctgacctgcagctgttgtatgcctccatagtatatctagcctctgatacgggaggcggctc

SEQ ID NO: 392275 - DNA, 498 bp, Homo sapiens
cccacaaaccgatatcagaggctacctattaaaactctcccatatacctaacacatacacatgcacacacatacaaaatatatacatatcacacacttagagaatgacagatttcaggcaatggccaatagtcagtattgagtttttctaaccccagaatctggttgggctttatgatctaaaaaaatgtggtttagaaaagaggataattggtagagctgtagtttgaaaatatcaggtcaaagttgcaaacatacttatgatggaatcatttcatttttagttcctttcccagaaaagctgagagagcacactgttccagctgacttttttttccattaatagccgttctattcaacaaagagctgcccacatgccaggaaagtgctacagtccttctaagcttttcacgaccagggatctcgcaatacaccaccctgttggaagacggcacgatcgccagcctcgaaagactacaagctcgactttagagtatcg

SEQ ID NO: 392276 - DNA, 752 bp, Homo sapiens
catatacacacacaaatatattgttctctttaatcccaggtctgagaatctaacctaaagaaataatcaaagtataaaacaagctatatacatgccaatatccatctcaacattgtcatacagaattaaggaagaaacgaaaatatccaacaatagaacagttaaataagttatagtaactttgtatacaatgcaattatatgatgtgttatacttatataatatattctaattacatattagaagatcatatattattattcagctgttgaagtaatcacaatgcttataataaaaattaagataaaaatattatgcacgttgtgcacatgtaccctaaaacttaaagtataataaaaaaaagtactggtcatgataataatgaaaacaaacaaaaaatattatgtataattacatattcactttatttaactacaaaaatcttgaaaataaaggaaatggactctattaaaacatattgaaatatcaatagtaataggattaaaaaatataagtgtagctgaaaattaaaagttgactgtcttctaatcttgattttcaaaggttagcatgaagagtggcaaggacttctttaacaataaatatagccaaaaatagcagggtcttaaggaaacttattttactgtgtcactatataaaaataattactttttataatgagttttgatagtaggtgcttattattcctagtagtcagactgagtttcagtgagtcacttttattttcattt

SEQ ID NO: 392277 - DNA, 159 bp, Homo sapiens
tattcttaggaataatacaagttaaaaaaggaattaatagttagggcttattggactttgggggacaattgattcaacaaatttgagcacctaccctgttcaaggcactcattttgtgctgggaaaacagcacagaaagtcatttcttccttcagagaa

SEQ ID NO: 392278 - DNA, 516 bp, Homo sapiens
gcacgagtgtaaatctgaggtggctctagaattaaattatctcattagaatgggatgttgttttttccacagaattcctccattttagcaagagtagtagcaacagctgctatcatttattaagtgtttactgtctgttagatactgtgttgagcaatttgcctgcagactcaaagtggataatgttatcttcattttacaaatgaaggtctagaaagtcagtaaataatttactcacaaatgcatatttgatacatgcacagtctggattcaattcctgtctccctgtcctcagtttgtcttccaaaccacagcatgggtctgacttatattggtctattgaaactattggagtcctttcacctactgagaatgcccattagaagctgactttagaccgggcacagtggctcacgcctgtaatcccagcactttgggaggccgaggcaggcagatcacctaaggtcggaagttcgagaccagccagcccaacatggcaaaatcccatctgtacta

SEQ ID NO: 392279 - DNA, 307 bp, Homo sapiens
caataagctttaaaaagttagtgccacatgaccagcatcgactggcctcagacatctgcaagcactcacccaggccacagggtcaggtagagggctcctgggcccactgtagcccctgctgggtcagtgtagctggaaggctacgggcccttagtggggagccacagcctttcccactagggggcctctcactctgacatctccctgtggtgttcggaccaagggtggggagggagacacgctggccctaaagggaggtggtaatgagtgaagatctccaggcccagcccacaggggctccgtccat

SEQ ID NO: 392280 - DNA, 636 bp, Homo sapiens
atagaaattaaactgtctttaacttaaaaggtgaacttaaacataagagaagatctgaccactgggagagatcctgtgtttagagccaaagctcaaaaagaattgttttctctcctcttaaaaataatggacaatttaaataagcatttaagacatttccatagtgaaactattttgctgactgaatacaaccacctacttatatttatttactgttttcttaagtggaaataatcttttccgttcatgttaatattcacctcatgatcattggtattgctgaaagagaaaaccacagaagattgccagtcttttaggaatataaatttaccttgtattggagtctgtttttttttaaaaaaaaaagcttgcccacagttattccttaatcttttttattttaatatattgtactataaatcatgcatatttgccttaccttactttataaaccatctctgaaatttagattcttctgttttatagcactttataaattgaactttactgaagaagcagcatcttttcatgaaatgtgttctgttgcttcaaaatttagctaatgattagccaaaaagatgtttgaatagtttttagtaacttttttcttagcaactttcaaaacatattaagtgc

SEQ ID NO: 392281 - DNA, 100 bp, Homo sapiens
gtcttgatccccatcactggcgaggatggggtggtgaagggacagtggaaggggtctgaggcagcacagatgtagagaaggaagtgccacccactgggtc

SEQ ID NO: 392282 - DNA, 380 bp, Homo sapiens
cccaccatggccaggccagaccagcccaggtacaactgttgatcagtgagaattgagagcagttcccctaaacaacactccctttgcttcttctgccatactaaggcctaggcaaatggatctctccaagaagggaggcaactgggctgcctttccttgtaccgtcagggggccttattcctatcctttctgtcccttcttactcaccattccctacactcctcccatctagtggtgtcatcctaacgactgggggtggggggcacccagaactgaggttgctatagtaacagatgagctgaggctacagccttctatagttgtggactgtatgctctcctccccctcgccccccatgcctcatttgcagccttagtctc

SEQ ID NO: 392283 - DNA, 180 bp, Homo sapiens
tctggctttggtatcagggtaaggctggccttaaaaaatgagttcacctcttatcagatgtatggctttcctcataatttttgaaaggtttaagaaagattggtattatttttaaaaatatttgacagaattcagcagtagcagtgaagctctgggctcgttttttctttttgatgggaa

SEQ ID NO: 392284 - DNA, 196 bp, Homo sapiens
atggcacctctcctgggttctgcccattctgcgcggcctctgctctgctcaaatggctacttaccttgaagagcttcccctctaggctctacctggttagttcctattcttttcatttgttctatttgtttgtttgtttgtttgtttgtttgtctgagatggaatctcactctgtcgcccaggctggagtgcagtg

SEQ ID NO: 392285 - DNA, 304 bp, Homo sapiens
ggattttatactaagtacaatgggaagtccctggagggctttgaggagggtattgtatcagttagtttctgctgtataacaaaccattgcaaatctgagtgacataaaagaagggccttttatttgttcatgatatgtggcttggcagtatgggctgggctcagctgggacggcttgcctctcacacatggggagcggctgacctcattcctgcatttgcggccagcaaatttaagacagtaaatgttgattactttgcacagtgcccagctcaagatgaaatgttctaaaaattattattatc

SEQ ID NO: 392286 - DNA, 142 bp, Homo sapiens
catggatttgctggtgcagtacaactaggcttaatagggacatgcttaaatgtttctgcgacttcctgcccttcctggatctcttttagactccttaagggaatgaggttttaaagacataaaagcagggaaggcaaaagaa

SEQ ID NO: 392287 - DNA, 434 bp, Homo sapiens
gagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaa

SEQ ID NO: 392288 - DNA, 100 bp, Homo sapiens
ccattttaattcattctattccattgcattccattccactccactccactctatttcattccattccattccattccactccactccactccattccatt

SEQ ID NO: 392289 - DNA, 218 bp, Homo sapiens
ccacctcagcctctcaagtagctgggaacatgatgtgtgccactattccctgctaagttttttttttttggtagagagaaagttttgccatgttggccaggctggtctcgaactcctgacctcagttgatctgcctgccttggcctcctgaagtgctgggattacaggcgtgagccacctcacccagccaagctatactttttctttttcgagatgga

SEQ ID NO: 392290 - DNA, 414 bp, Homo sapiens
attttatccctcaaaaccagcccttataacctcatgtgccctggcccaaagggaggcagcttgtatagttttagcagcagagcattagcagtgaaacagatccagggtcagtgggataccaaatgagggagattcatgtttctagtcttcagaataccatgatttcggtttccttggaagtaaaacagggagagataaataatggcttaatctgcacttaaaaagtcagggcttagtttttgccatcagccccgataaatgctccacacaaaaggctatgcaatggaggatttacatgagcagatttacatcttcagttttacagtactagaaaggggaaaacatcccccaattagatgtagaacccattttcttttcttttctttctttttttttttttttttgagacacagt

SEQ ID NO: 392291 - DNA, 714 bp, Homo sapiens
gattgagtgcagtggcacaatctcggctcactgcaacctccgcctcctgggttcaagcaattctcctgcctcagcctcccaaatagctgggattacaggcgcatcccaccatgcccagctaatttttgtatttttagtagagacagtatttcaccatgttagccaggctggtctcaaagtcctgacctcaagtgatccacctgccttggcctctcaaagtgctgggaatacaggcaagagccacaccgtgcccagcctgagagccttgagttctgatctgtcttttcctctcctactcaaactcctctaccccgaggcagaagcatagctggggggatggaggtggaaattggttgttgcttttcctccagaagagttggttcaaaatttttaaatttaaagtaaatgatggtaagatcatgatgcaaggatgttagaggaagcagccagactttgagatcagggctgagagaaagtagtcaaaggccttctgctgagtgtactctgcctccagccactgagcccacttgccccatctctgtctttcccgggcctgctcacgtctctagcctcaggcactgcttcagaaccacagtaccatctggcctgggtgttctggctgttctcagtatttctgctctcatttgctggaattatgcaacactcggtccttcctccgagggccgccagatgagcctacttcagtgcatctgc

SEQ ID NO: 392292 - DNA, 1089 bp, Homo sapiens
gagcgtcccggcactgcaggtgcccgcagatgcaggcggggcacaggatgagccattggagacttccctcttgcttgagagatgggttctagaatgctgttttaaaataactcttagaggtgggttaagtgggtggaatatagatagagcaggaaactgcagaaggcactggctgggggaaagagtcccctcagagatgaggatgagttgagttttttctctgttcagtgaccgcgccccctgcccccgctccagcgaagccccctgtttatcaacccacttggtcagaagacatttcaccacagccagaaaccaggtatgaatgaatacccagggagctggaaacgcaaataagaacctcagaacttataagcaatcagccccatcactctaacaacaataacaacaacaaaataaatcaacaaagcttactgaaccaaagccaatggcaacaaagaatgctgaagtggcccccagattcccctggctccaccctcaggaccagctttccttcttctgtgagagacccgtgcaggccctttaaccagccggactccgctcggagggtctcgcctcggcctggtgctatgactgctgatgcctacacaactgcttcccctcctcactaaaccccagctcccatgctgccaccaagcggcaggttgctattctttcccggggttgaaatccaaatactacctgggctgtgtgactctctagtgtggatgcagattagggtggtaagccaaagggttgaactcccagttccacacccgatgggaaatgtcatctctacacagggtcagctacttcatgtccatcgcacgcaccaccaccacgtgcatggtctgcacctgacccaagctgaatgatggacatcacctgtgtaagcatcttgatgaagggaaaagctcactgggtgccagtcccatcccttccgtcctctgggcctcagtcttctctgtcaaacaggcaagactcaaaaggctcctggagacccaacaggccaggctataaagcaagacatgaccccagagcagccacctatctcatccttgggccagccggggcaggggcagctggggggac

SEQ ID NO: 392293 - DNA, 392 bp, Homo sapiens
ctcaaactcctgacctaaggtgatctgcccgcctcagcttcccaaagtgctgagattacaggtgtgagccacccagcctggccttaatttttttaatgtgtgtatttattaatatattaatatttcatttaacctttttttaaaatttttttttagacagagtttcactgtcttcacagagtttcattgcacccaaggctggagtgcaatggtgttatctcggttcactgtaacttctgccttccaggttcaaacaattcttgtgcctcagcctcccaagtagctggcattaaaggcacacaccataattgccagctaatttttgtatttttagtatagacaaggttttgccatgttggccaggctagtctcaaacttctggcctcaagcag

SEQ ID NO: 392294 - DNA, 512 bp, Homo sapiens
ctgggcatttacaatgtcgcaggcacagttctagacgctgggactacagctgtgaacaaaagaaagtccttacttctccaatcgttttcattctacggatcacgatttcaattatttcagcaaccatacagttatatggtctagaacatttctaaacctatcagcctcacgacaaaacacggcttcaaagttctttttttcccttggacgctaagtgttcttaacagcttaaaaagggacctcatatggttaattcagagcatgacaatattccttcttcaaagctcaggcaatgccaccacctcatatctataaagtacatcacagtttaaagcggatttccctccacgttcattttcaaagcgaaccaatacacggggtaggtacgttttctggtgctccacagccacccataccaacctttgacttggtttggaaattcccaagggttagggctcagacaggcagaaggccagctctacctgcagagctgacctggacaagtgtctccg

SEQ ID NO: 392295 - DNA, 659 bp, Homo sapiens
ttcgaggccgatatcgacgccaccaccaccgagacctacatgggcgagtggaagaacgacaaacgctcgggcttcggcgtgagcgaacgctccagtggcctccgctacgagggcgagtggctggacaacctgcgccacggctatggctgcaccacgctgcccgacggccaccgcgaggagggcaagtaccgccacaacgtgctggtcaaggacaccaagcgccgcatgctgcagctcaagagcaacaaggtccgccagaaagtggagcacagtgtggagggtgcccagcgcgccgctgctatcgcgcgccagaaggccgagattgccgcctccaggacaagccacgccaaggccaaagctgaggcagcggaacaggccgccctggctgccaaccaggagtccaacattgctcgcactttggccagggagctggctccggacttctaccagccaggtccggaatatcagaagcgccggctgctgcaggagatcctggagaactcggagagcctgctggagccccccgaccggggcgccggcgcagcgggcctcccacagccgccccgcgagagcccgcagctgcacgagcgtgagacccctcggcccgagggtggctccccgtcaccggccgggacgcccccgcagcccaagcggcccag

SEQ ID NO: 392296 - DNA, 260 bp, Homo sapiens
aatccttatgtagatccaccttttcttccctgacagctactccacattcccaaattatctcctcattctacttcaaaatttcattgcccattcataaaataaaactaatgttacctgcatgttgatttaaatagaattatcaggccaggtgtggtggctgacgcctgtaatcccagcactttgggaggccaaggcaggcagatcacaaggtcaggagttcaagaccagtctggccaacatagcgaaaccctgtctctact

SEQ ID NO: 392297 - DNA, 397 bp, Homo sapiens
gagagagagagagaaggagaaagaaagagaggagacagaagagaaacatctacaaagcaaggaacaccaaagattgctggtgcctaggaaactaatataataacataatatttggggcctaaagtgttacagctgcaccaatatctcccaaatcttgctcctagctcctgccccagcctgattttctcagtgactcccctgtgtttccctctgccaccagcccctccttctgcctgctgtgtgtgacagttcccttgccactccctccggcatccgtacttcaaactggggagttagttatttccattgtttcttattgcagcctctggctctgacgtttccagagctgttgcatagctctattgagtctatctccttaaatgcattttcatccact

SEQ ID NO: 392298 - DNA, 598 bp, Homo sapiens
ctccctctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagcccccattacttcagtcaagcccaaatttcatcctcatctgttacctatctcagcataattctcataaaaacacaggtgctctccctgctgatcgtgtccgattaatctcccaaacctcaatcccttacaaaagaacaactcctttccttcctaggcatggttagtgtggtcagaattcttacacaagagccaggactgcaccctgtagcctttctgtccaaacaacttgaccttcctgttttagcctagccatcatgtctgtgtgcagccgctgccgctgctttaatactgttagaggccctcaaaatcacaaactatgctcaactcactctctacatttctcataacttccaaaatctattttcttcctcatacctgacgcatatactttctgctccccggctccttcagctgtactcacactttcttaa

SEQ ID NO: 392299 - DNA, 775 bp, Homo sapiens
cgcggtggctcatgcctgtaattccagcactttgggaggccgaggcgggcggatcacgaggccaggagattgagaccatcctggctaacacagtgaaaccccgactctactaaaaatacaaaaataaaattagctgggcgtggtagcaggcgcctgtagtcccagctactcaggaggctgaggcgggagaatggcatgaacccgggaggcggagcttgcagtgagcggagattgcaccactgcactccagcctgggcgacagagtgaaactcctccatctcaaaaaagaaaaagaaaaagggaaaaaaaaaagaagaatgttaacttcagcgctgtctataatagcaaaaaataggaaagaatctaaatccttaccaaaagaaaataatatattcatataatggattactacatagctgttaaaatgaataaattatataaattccaacatgaaagaagtttaaaaacctaatgttgaatggaaaacgttatacaacaaacatgataacatgaatgaatggttaaaaagcataaaacaatacaaacacatttatttaaaataaactggaaggatgtaccaggtccatgacggtgttacgtctggggaaggggagatggagggcgtggccaggtggtaatcaaagagtcctttagtttggaagcaaatatgactaccaatgctaacaattaacataagttaattctacatatagagaagatatgggtgtaggctgcctttgtacttttctatatttttccatttcttaaaaaaaaa

SEQ ID NO: 392300 - DNA, 263 bp, Homo sapiens
tcagttgtgtttcatgatttaaaaaaaatagataagagcattacttcccaagtacctccactttataaaaataagtgaaaagagactcagaattgcctgtgtgtatttctgtatcctcactcacattcttgaaaattaacacccaatatggttgactgctgctgggcaagacctaagaatgatagagaaaccatttgattttgaaaaacatccacttcagcaggttattatataattacatgttcacagttaaatttataagt

SEQ ID NO: 392301 - DNA, 331 bp, Homo sapiens
cccgaagccctcaaagtcatccacgaggattagaatcaacttcttccaaactcctattaatgttggtattttgacctccttccaagaatcacaaatgtgcctcaggcatctaaaatggcaaatcctgactatgacctgcggcagcagctgagacacctgcgaagggatgcatcttttcttctgtaggcttgagtcaagaactctcggtcttcttggtaataccgggttggatgtcaaaagttgcagaaaaaagaccagaacgttcaggaaaaaacttaactgtatccagcaattcagatatagcgaaagtgaagtcaatgttccaggaagt

SEQ ID NO: 392302 - DNA, 245 bp, Homo sapiens
aaagactcaggggctgtggcctgcctcactgggaattggtgctgtgtgtggttagtgatgtctctgttgcttgtggatagtgggatgatggtgagatgaggtgatctttcttgcctatgcctcctttttttttttttttttttttgatggagtctcgctctgttgcccaggctggagtccagtggcttgttctcagctcactgaaacctccacctcccgggttcatgcaattcttctgcctcagc

SEQ ID NO: 392303 - DNA, 640 bp, Homo sapiens
ggatcatacggatgtgctggggctgcagcgggcctctacggatgtgcgggcgctgtgtgcatgttgtttgtacacaagactagatctcctggaccttgaaaacaggacagggagtagtatgtgtgataaggagcgctgaacacagcctcctaaaaatgtggtttgagtgttttttacaaggccatatgtgcctcatacccgaccgccaagagccacctggtggatgtctcttgtttgtctaaattgtagtttaaacaagctctctcaataaatacctggcagacagatcttagagtgacgctctctcaaaggaactgctccccgccccgctcagctagaattgtctgagtacttcattctcggcattcactacagccataagttgcacccaggtgcgatcttggctcactgcaacctctgcctccttggttcaagcgattcttgtgctcagcctcccgagtagctgggactacaggtgcccgccaccatgcctggctaatttttgtatttttagtagagatggggtttcgccatgttggccaggctggtcttgaactcctgacctcatgattcacccgtctcagcctcccaaagtgctcagattacaggcgtgaggcaccgtgcccagcccctcctaatc

SEQ ID NO: 392304 - DNA, 194 bp, Homo sapiens
gctccaaggctggggagggaggcctggatgatcctagtatgcttttcaggttcactgtctgcaggttctattttacagaccagactgactgtgaataaacctcaccacacagtgacatggatcacactcaccaaagacaaaactgcagaaaatactggcatcgatttgggtcaacgggatgattaggtgatcgt

SEQ ID NO: 392305 - DNA, 503 bp, Homo sapiens
cacatcctactacttatttatggcccaattttaacatgggggtggagttgaggttggaattgttcctccgcctctgctgcacatgctcagtaagcaagaacactgttgatgggaaaggcttagtcacagacagtgggagcacatccctccttggagctttgggtcgctgtgctccagaaacagttagttatagcacaccctgctcctggcatctactggaaggtgaagcccttgaccctaagaaacattgggaatgatttgtaccctccaaagtccaatagctatgtcggagggaaacgatcaaagaacatgattgaggagactcaaacagagatgtgcttcagacaacaccaagacagaaaattaatccattttaccaagttaacaatgtactgaaggcgaacaagagaccaacccacctgccaaccaacgctatgaagaaggagggttgatcagtctggctaacatggtgaaaccccatctctactaaatatacaaaatta

SEQ ID NO: 392306 - DNA, 454 bp, Homo sapiens
tcaactgccagtattaattatgaaagcaaaagaagaaaagtctataaaagtaatggaatgcgaataaaggtagaagggatggacacacttttgcatatattaggtggaacgttagcctcagtaatgaagagccaggacacattcaaacctgtgccagactgtctacggagaggatagaagtaaattaaagaagataacccagtaaactaatttagtcttgcttctattaaattttctattttaatttactaacttcattttaaaaatatgctgtcgtaacgtttatgacttttgcaacaacgatggcatttatcatcatgtgatgattatccatacatctgcctcttccaccaggtgagttcttgacagcaaagacggtgttttcatctctgcttcctccacagaccagcagcaaagtagatggcacagagcggacactgcaaatagtctcgta

SEQ ID NO: 392307 - DNA, 142 bp, Homo sapiens
tcttaactatacagtcacctgttgtttcacaggtaatcagacttagattagaaacaatgataaccaaggcccatttgccctaggcaaaaggctggcggcaggaggccttaaagagatttaacaggctctgtgttttatttca

SEQ ID NO: 392308 - DNA, 789 bp, Homo sapiens
ggaagtattcttttaaaccccaaatgaaagctaaatagaaattacagactcaacagagttgtatcagtttctttcaattgcaatgatggagacccaacataagctagcttagctagaatgggaatgaatggtgtcttcaatcgcaagtccagttaaacaacatatcatctctcttcaaacatatcatctctccctcttggtaggcttctttgtgaagatttcattctctctcccacagcaaacaaatttcttctgtgctgctggagaagagaaccacaaagtggcctagacctatacgctccaggccctgcaaactcagggagcacagaatctatatttcccaatgttaagtatccagaagattctgaatggttttgttagggttacatgcccttcctggacaaatcttaacccctgaagatggaatttatgattgaccaggcctggatcaaatgactagtagccatgggaaaatactaataccagtacaatgtaagtacatttgcaagttatgatattcattagaaaatcagtcatgttaattaaagaacctacagtgtgtatctaatccccaaagaggctgggcacggtggctcatgactgtaatcccagcactttgggaggacgaggtgggcaacctgaggttgggaattcgagactggcctggccaataaaatacaaaaattagctgggcgtggtggtgcatgcctgtaatcccagctactcaggaggctgaggcaggagaattgcctgaacccaggaggtggaggctgcagtgaaccgagatca

SEQ ID NO: 392309 - DNA, 649 bp, Homo sapiens
aggttcaagcgattctcctgtctcagcttcctgagtagctgggattacaggtgtgtgccatcacgcccggctaattttttgtattttagtagagacggagttccaccatgttgcccaggctggtctcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatgtttggactcttgattgttagttccattgatgtttgtcttgatttattttttggccttgaaacaacaatttattatcatctctcatgatattggaggttggccaggttcagctgggcaattcttacttgggttctctcatgcatttgcagttggatgatggctggagcagcaatctggaggctcaaggaggctgaaggccccatatgactccttcatttccatatctagcacctcagtggagtaggctggaacagctggggaatgattgagcttctaattctctccctacctcctatcta

SEQ ID NO: 392310 - DNA, 533 bp, Homo sapiens
taagctgttgcatgtgcttggctcttatgttccaaaaagtacatttgtatggttttgtggaaactgtgctgttctgcttttgcagtctgtgagattctgattttttttttctcatcagcaattatccttgtcttggaacatcagagcttgaagaaagggattctagcagccccacctctctccttccctaatcccagatggttagaggccttagagagaggtggtggttgcctctgagtttacccagattcagtgacaaaccccttctaatttctaatcaatctggcagccttcatttaccaaaagttgacttttgatagtataacttttatacaccgtgagacaacttattttaaaaaacagtttagaaatatttaatttttttttgaaagactttttaaggtcaggcaccatgggtcatgcctatcatctcaacgctttgaggactgaagtgggaggatcatttgaggccaagatttcaagatcagcttgggcaacatagtgagactctgtctctaaaaaattaaaaaaaa

SEQ ID NO: 392311 - DNA, 491 bp, Homo sapiens
caacatatattctgagaaatgcctcattagacaattttgtcatagtgtacttacacaaacttaaatggtagtgcctactacacacctagcctatgtgccatatagcctattgctcctaggctacaaacctgtacagcatgttgccatactgaatactataggcagctgaagtacagtgataagtacttgtgtatctaaacctagaaaaggcacaatataggctgggtgcagtagctcaacgcctgtactcgcaacaagactgtgcaactgcactccagcctgggtgaaagagtgagaccctgtctcaaaaaaaaaaaaaaatacagtataaatagggtattataatcttatcagaccataatcatatacatgatctgtcactcatgaaatatgcagcacatgactgtatatgtatttttgttcagtaattacactgtaacttttaccttattttgcaacttttttttaacttaaaagacttaagagatttg

SEQ ID NO: 392312 - DNA, 170 bp, Homo sapiens
tcttccctgggaatttagctgggactaggaaggggttttcagttctttcagtggcttcttttgtttgactaaaggtttatttttctgtaattgcatgcctgctgcctcatccatggtacctggaagtgggactttgaaacccaggaagttaacaagacttcagcaagatt

SEQ ID NO: 392313 - DNA, 279 bp, Homo sapiens
ctttaaaaaactttaaatacatttagtgcctgcacttaataatttgtatctaagctgagttcaagatgtctaaaactggaagctatgagaaatttctgtttttcctcccagtctaacatactgttttttggacagaatccccatgtgacttgattaatgataaggaataatcacaaagtattttaaaaattattttctgtaaagcttcatagtctatatcttaagatggtaactatctctgtgtatatgttcatttattttaataatgcttttattatt

SEQ ID NO: 392314 - DNA, 310 bp, Homo sapiens
gttctgtggtctttggtggaagccagtttgttgtaagagaatgtagagcttattaatgtaagtcatttggggttatattgtggagggttgtttaggattgcatggcaggaattgggtaaatgaaaggtaacactaaagattggagatggtataatggcatatctacaggtctgtgtttccttatctgcgaagtgagacattgaaatagatctgttttgcaaattgtggattgcaaccctttagtgatttacgaccagcattaatcactaacccctttcctaccccagtgtaaaacagaaactatcagtgt

SEQ ID NO: 392315 - DNA, 762 bp, Homo sapiens
aaaaagtgggaggtgaggtgggtcctccccttttgagccacacggatgtagactgagagtggtctcattcccactagaacagaaagtactgttactagctgtgagactgaaaaacaaaagggggcagggatttaaaaacactatagccatgggattgacagaactttacacccactggcccattagagggctgacagaagaaaagaagtctaaggtggctttgaactttatagattggccaagtggatgagggtgaagccatatactgagaaatttgcagagaaaagaaagtaaaggctaacagcttaagaattctgattcgacgtcctttgaggatacttccaacttaacattttgtagtactagggataaattattggagcctcgaagaacaaaggggagtggaatagcatttgagtaggtgaccattaaaattcaagtggcacaaatgaggttgagatattcaaggcaccactagcatccagagaaatttattgtagttgaatttgaatatttacttttttatttttatttatttatttgagacagagtctcgccctgtcacccaggcgggagtgcagtggcacaatctcggttcactgtaacctctgcctcctgggttcaacaattcctgtgcctcagcctaccgagtagctgggactgcagatgcacaccatcaccccaagctaatttttgtatttttagtagaaacggggtttcaccatgttggccaggctggtcttgaactcctgacctcaagtg

SEQ ID NO: 392316 - DNA, 326 bp, Homo sapiens
atattttattggccctgagaagatgatattctaaaaaactgaatgtcttccaactttcttacctgtttttctttgtatcctagctccagaaggattaaaattaatctcagttattgctggttcttatggttactatattttactgactgtattaggccattcttgcactgctataaacaaatacctgagcctgggtaatttactttttaaaaagagttttaattggctcatggttctgcaggctatacagaaagcatagcagcatctctttctagagaggcctcaggaagttgccaatcattgcagaaggcaaaaagaggaacagg

SEQ ID NO: 392317 - DNA, 1227 bp, Homo sapiens
ggctcggcgactcagcacaggctcactcagacccggcctcttagagggaagcgcggcgcgggcgcgggggtggggcgggccgggggagcgggccccgaacacctgccggcctagcggccgagcagcggggatgtttagacgatcttccagcaatgcgaccgaggctcccccggctttcttgcgttggtgccttggcagggctgggggcggccagctaggggccccttgcctatgaggtctgctgacccagaaactttgctacgagcttccagccaaggaccaagctgaggccgactttgggaacggcagcaccgtggtaaagaggcacagcctgtcgtctggcagggtcagccgctcagccagtctgtcttcttatccactcagccggtccttgtggatcatctcctttacggaccctgtgttagaaagaaggggaattgctttgtcgaggactgtcagagagtgccaagagcttcttgatcttagactgcgcggatgggtttttttgtacctgatgtgtacaaagttccctgccagctcttgccaagaattcaaaggagtaagaataattgatcatatagccatcattgaagcagcgccagacactgtgctaagagcttcatatgcattaccccagcgctcctgttctcgaggaactcctgtcgtctagagaaggtgaaatatttacagtgcctgctgcgtgtggagtgacgtggaccaccatagtcgggggctcagacaaggggcctccagttctgatctctctcactccccttcaaatctgaaacgttgaactgtcctgcaggattgggtcacctctcttatagcctgtgatttgggattgtgtgtagcattgtccatcctaagagaacaggagccaagtccttttcactccaaacatctggcacattgtctctgctttctacaatattcactcatggccgggcacagaggctcaggcttgtaatcctagcattttggcagaccaaggcaggtggaccgcctgagtgcaagaccagcctgggcaacatactgagactccatatgtacaaaaaatttaaaacttagccagacctggtggcacgcacctgtagtcccagctatttgggaggctgaggtgggaggatcacctgagcacagggaggttgaggctgcagtgagccaagatcacgccattgcacttcagcctgtgtgatagagtgtgactccgtctttaaaaaaataaaa

SEQ ID NO: 392318 - DNA, 1173 bp, Homo sapiens
ggctcggcgactcagcacaggctcactcagacccggcctcttagagggaagcgcggcgcgggcgcgggggtggggcgggccgggggagcgggccccgaacacctgccggcctagcggccgagcagcggggatgtttagacgatcttccagcaatgcgaccgaggctcccccggctttcttgcgttggtgccttggcagggctgggggcggccagctaggggccccttgcctatgaggtctgctgacccagaaactttgctacgagcttccagccaaggaccaagctgaggccgactttgggaacggcagcaccgtggtaaagaggcacagcctgtcgtctggcagggtcagccgctcagccagtctgtcttcttatccactcagccggtccttgtggatcatctcctttacggaccctgtgttagaaagaaggggaattgctttgtcgaggactgtcagagagtgccaagagcttcttgatcttagactgcgcggatgggtttttttgtacctgatgtgtacaaagttccctgccagctcttgccaagaattcaaaggagtaagaataattgatcatatagccatcattgaagcagcgccagacactgtgctaagagcttcatatgcattaccccagcgctcctgttctcgaggaactcctgtcgtctagagaaggtgaaatatttacagtgcctgctgcgtgtggagtgacgtggaccaccatagtcgggggctcagacaaggggcctccagttctgatctctctcactccccttcaaatctgaaacgttgaactgtcctgcaggattgggtcacctctcttatagcctgtgatcactccaaacatctggcacattgtctctgctttctacaatattcactcatggccgggcacagaggctcaggcttgtaatcctagcattttggcagaccaaggcaggtggaccgcctgagtgcaagaccagcctgggcaacatactgagactccatatgtacaaaaaatttaaaacttagccagacctggtggcacgcacctgtagtcccagctatttgggaggctgaggtgggaggatcacctgagcacagggaggttgaggctgcagtgagccaagatcacgccattgcacttcagcctgtgtgatagagtgtgactccgtctttaaaaaaataaaa

SEQ ID NO: 392319 - DNA, 416 bp, Homo sapiens
accaatgtattgtacactcacatacatgtacatttatgctccaacaccttaccatataccacctggattcataaataacaggtctccacacaacatccttagacattttacacagacataatacacattcctacatttgtactcaaacctttcctccactctcacactgcatacttgaatacacacaaataaatgcatgaatctacaaacatgaccagatccagacactgcacaagacattcgcgccacacgtacaaactcaaaaaatgccatgacttccacatattacatacctgagtctgcacgcaccgggtggatttgtaagcataacagcattcctcactgattactctgtccatgccacacaccacacgcgggcactgaactctactcgctgcacccgctgcacgctgtgc

SEQ ID NO: 392320 - DNA, 565 bp, Homo sapiens
actaataaaaattactctcaaactctttcaaaaaagtgaaatagaggaaatacttccaaactcattttattaggctaccatcattctgataccaaagacagacaaggacactacaagagacgaaaatactaggccaatgtcagtaatgaaccctgatgcaaaaatcttcaacaaaacattagcaaccaaatttaagaatatatgaatggaatcattcaccatgatcaagtgggattcatcctttggatgcaagttggtttcaacatatgcatatgaatacatgtgataaaatgcatgaacaaagtcaaagacaaaaatcgtacgattctctgaatacatgcagaaaaagcacatgacaaaatttaaaaccttttcatgatgaaagctctcaacaaaacaagtgtacagaaaatgtatctcgacacaaaaaagaaccatgtatgacaagctcttagctaatgttattctcaacgtgaaaagttgaaagcttttcctccatgttcagggacaacacaatgatgaccactctcaccacttcttttcatcgttaacagtggaattccta

SEQ ID NO: 392321 - DNA, 574 bp, Homo sapiens
gtgattgaaaatttcctatgaactcagggttgggaatagcagaaaccaaaactgtctctggtctcaaagagcttataatcaagcagggcagcaaacataaaaaattatataaacacttatttgctgaaattgtgacaaatgacatcgaggacacttagagggtgccgtgagactatgatcagagaaggtgatggggagaaggagggtggctaacctagtgatcaggggagttgagacaggcttttctaggaaagtaatctttgaggtgaagcctggagtatgaagtaggagttggccaggtgaagagaagagagaatcaccttccaggtaaaagggaactactgtgtgtgcaacagcaaaaggaaggaacttatctatgtgccaggcattgtctttgtgcctccacgtgtggaatcccatttaatcttcatagttgatttacaaatgaggacaagacagtccagagaagtcatggagcttgtccacagccacacagctggtgggaaatggtagacctagacttagacccagcctatgtcttgaccctgtgcccagcaccactgcattgcaccct

SEQ ID NO: 392322 - DNA, 614 bp, Homo sapiens
ctgccagagtttgacggagactctctgcaatatcccccacagttgatatcttgtttgaagagaggcagggttgcacagtatctaaatgcacacgctttgagtcagagacacatctgggttacccaggctctaccccttactagtagtcatctagactaagtaccttaacctcactttcctcagttgtattagggggtgataacagtaccaacctcatagggctagtgtgatgcttgcatagactactaaagtggtacagtaaggacttagcatgtagtaagtgctcatacaaaatgttagctagcactgactactgctataataggcccattccaaagttaaaacagctccaactatcaggaaggtcaaaaccagctgtctgcttcctccctctcatgaatcctagtctgccctacagaatttcaccagtctctgagttgctgtcaacagggagggtggatggggccatggcccacctgagtctccttgttaccaagcagaacatgcccagcttcctcgacggttcctcaggtggcctccatgatcaatgtgctctcccctgatgtgctcctgcctgccaggggagagtctccgtcaactgggcgagctgatga

SEQ ID NO: 392323 - DNA, 493 bp, Homo sapiens
tcatgcagaccccagattcatggacccccaacaacttgtatccttagtggggaagggtcacaggcactcagcaccagccggggtcctgagggcagccgtgggcataaaccctgcaaagccacaggtgccaagctgcccaaggccttgggagcccagccctcacacccctgtgccctggatgtgggacagggtttcaaaaagggtgattttggagctgtaggattgaatgactggccttttggttttggagtttcatgggaccggtaagtcctgtctatgttttgttttttttctggcaaaattctttcttttggctgggaatgcttacccaatggctctacaaacattgtaccttggaagtagttaacttgctttatagttcagaggctcatgggcctaagcaactgtagccttgtgccagatgagactttaagctttcaacatttgaataaatgctgtaatgatataagattttggggaatctgggagggaa

SEQ ID NO: 392324 - DNA, 548 bp, Homo sapiens
aaaatcagaaggcagagaagctatgggactaggatttatagggtaaaaaggaaggagcagagagagagcaagggagctcaagatctttagagtttggttccaagtctttggccaagtactgacatgtacatgcatgtatatgcatgagaggaaacaacttgagaccagggaaagctcacacaaagctgggaataattctttctccaatgaaccaaagtggaaagatctcataattaacagggcatgtgtagtcttcaaaagggtattgtgttggtggtgctgaattagacctggactaaagggtattcttgacccactgttagaaatattaaaggcaaacctggaaaaggagcaaactgattccaagtcacttaactgcttgccagaacaaagtctgacattctttgaaggaatacagcaaaatctagcacccaaaaatataaacattttaaggtctggcattgacttaaaaattactagcatgaaaagaacaagaaaaaaatgtaccctgtaacccagagaaaaagtaatcagtagaaacaagagtc

SEQ ID NO: 392325 - DNA, 776 bp, Homo sapiens
atagtttaagagactaatgcattaaaacttattttatgtttttggacacaatatataaagataggcttttgtcacaattgtgacagcagttgaaagaggcggggatggagctgttataggtgcagaatttttacatattgatgttaagctggtataaatttagagtgttataactttaggatattaaaagaggtacaaaaaggctatgagacatacagagaacgaaggcatatagaaagcaaaatgacagaagcaagtttctcctgagcagtaattactataaatgtaaataaactctccaattaaaaagcagaggttggcagaatggattttaaaacaccatactccaactatatactgtctacaggagactcactctagatccaaagacacaaataggttgaagtagaaggatggaaaaggttatgccatgcaaatagcaccacatgatccagcaatttcacttccgtgtatatactcaagagatttgaaagcagggtcttggccgggcatggtggctcatgcctgtaatcccagcactttgggaggctgaggcgggtgaatcacctgaggttagaagttcgattccagcctaaccaacatggtgaaaccccgtctctactaaaaatacaaaaattagcgaggtgtggtggtgcatgcctgtaatcccagctacttgggaggctgaggcaggagaaacacttgaacccaggaggcggaggttgcagtgagccgagatcacgctattgtactccagcctgggcaacaacaatgaa

SEQ ID NO: 392326 - DNA, 355 bp, Homo sapiens
ctcatagcaagttgtcccacaatgctctaagaaggagagctcctccagcccagcagttgctcattctggtttacatggggttgaggaggcagaggctgctgtcctgcctagaactccaaaatatcatgaactaattaagaatcactggccgggcacagtggctcatgcctgtaatcccagcactttgggacgccaaggcgggtggatcacttgaggtcaggagttcgagacaagcctggccaacatggtgaaaccccgtctctactaaaaataaaaaaattagctgggcatggtggcacatgcctgcagctacttgggaggctgaggcagaagaatcacctgaacccaggaggtg

SEQ ID NO: 392327 - DNA, 398 bp, Homo sapiens
ggcatatttttatcagaatcatttttgttacttatttatgtccactgtagaaatcggtaaacataataaacaataatgaaaatgaagatctcagtgtcatcacccagatacaactactgttagcaaaacgatcacagtatcttcagacttcataggaattcacatgaatgcacatgaaataaaatgtgttatatattgtgtttcaaatatgatttttgctcttaatgttttgtgaacatctcttgatgtaatctataatttttataacagttgcatagaattcccttgtgtgaatgcagcatacttgttcaatcagtcctctgttcatggacattatgatcatttgggttctttggctattgtgaactaagttatattaaacactcctgtgtattcat

SEQ ID NO: 392328 - DNA, 975 bp, Homo sapiens
tctgaacagaagcccaccctccacccctgacaccatgacccactgttgctccccttgctgtcaacctacatgctgcaggaccacctgctgcaggaccacctgctggaagcccaccactgtgaccacctgcagcagcacaccctgctgccagccctcctgctgtgtgtccagctgctgccagccttgctgccgcccaacttgctgtcaaaacacctgctgccagcccacctgtgtgaccagctgctgccagccttcctgctgcagcacaccctgctgccagcccacctgctgtgggtccagctgtgaccagagcagctcctgtgcacctgtgtactgcagaagaacctgctactaccccacaactgtctgcctgcctggttgcctaaaccagagctgtggctccaactgctgccagccctgctgccgcccagcctgctgtgagaccacttgcttccagcccacctgtgtgtacagctgctgtcagcctttttgctgctgatcaagtcccgagagaaccaccatcctcacacaacaactttctgctcaactgacttatcttttgggggactaatttaatttgctgctgacagccaccatgctctcacccaaatttttatgaattctctacatgtttaaaatcttgggaatctgcttgagggagggcagaatacttcatcctgattctctttttccttacactttgtggatcatgtgccagcttcgtgtgttctcaattttgagtcatggtctcagctttgactcaaaagtcaagagcttcattctctgcttctaaggaatttaggtttctgcaactgatcaataatctttgcaatcatatttttgttttcaatatcctcctcatggttcttgtatccttctttcttcttttcataactttgggttatgtttctgctaccagcagagattcttagctatatgtttctgaataaactctgaaccatcctcatctcatat

SEQ ID NO: 392329 - DNA, 347 bp, Homo sapiens
aaaattcccagcctagaccaagcaggaaaaacattgatttcaatgaaataattgataataatgaggataatgtttttatgattttcatttgaaaatttgctgattctttaaatggtttgttttctacattgacggaatttttctcttttaacctatctgtagcttatagcagttcaataaactataccgcagtttattgaactgtaattgaaatatttacttttgctttctacctgactgccccagaattgggcaactattcatgagaattgatatgtttatggtaatacacatatttgcacaagtacagcaacaatctgctctctttgtaacaggacacatttcaa

SEQ ID NO: 392330 - DNA, 256 bp, Homo sapiens
tgcttgaatgttgtatatttgctaagatcccagatgatgaaatgagaagcacagttttcatgctttctccttactaaccttgtgctggttatacttttttaaaactgtttccttgatgttgcaatggtgtaatccagtgagaatagatgactggctcaaagtaagcactcaataaatattgactgtgttgactctcattactttaatcattagtatctttaaatacacttaataaaagcctttcttaacaagcata

SEQ ID NO: 392331 - DNA, 323 bp, Homo sapiens
cccccccaaggagcccacccgggcgcaaaaaatgggaaccccaattcccaaaaaaaaaaaaaaaaaaaaaagaaaagttcatctgttggtttcctggcatgtgtttccagctgagagatgctggcctcatttttttctctcaagacttcagtgggcagtggtagaaaacatgactaccaaattcagtctaagacttaaacctatcagttgctcatccacggaagtgccccaggactccgttagatttgcctcatcccacagtccttccccagtttagggccaacctgtattcttggtgtgcacattttcccacatcatgacca

SEQ ID NO: 392332 - DNA, 347 bp, Homo sapiens
ttcccccagatgttcttaatttgggggttattttccattgcatgtgggcccttcagtactgtaaatatttgacttcaatattttccatagcttgaagaactttacagtggtcacttcagacatggttacagaatgttctctgatcctttcaggctgctctgtaaattagaaacttggtagttgatatcttgtgggctccacacaccattttttttttctcagactttgatgtctaaaagtgcattgtgttatttaggccttaggcacgtatagagatatccctgaagcatagatcagggtggctcatatgaatgaattttttccaattaatttatcctctatggtgg

SEQ ID NO: 392333 - DNA, 219 bp, Homo sapiens
aaacagtgatttacacagacaacatatttctaacttaggtgtttgtgcctcctagagttgaccgatgaactatcaaattgtcacacagttctctcactaggctcctaagtgtctgtgtcacagccagtggcaattttaagtggtccaaggatgaaagtgttgagcaactaagacagagccacctgtgaatcccaagagctcccgctgccccaggatggg

SEQ ID NO: 392334 - DNA, 305 bp, Homo sapiens
tttttccccttgcaacagcaataacatgaggaaaacttgactcttttaaacaaagctaagtcacaaccatttagattttattctgagtccaaactgtgggtataaatgataaactataaagtatctactcaagtgcatacctttgactccacaatctgtttcagatattgccaggtttttctgcaatcctttatgcctcaagagttgtaatttgttaagtccacttccttatttcctactttctcccaaattcatttccaatcaggctttaattaccactccttaaaagaataacttaactttca

SEQ ID NO: 392335 - DNA, 279 bp, Homo sapiens
cagtggtgcagtctcagctcactacagtctccaccaaccaggttcaagtgattctcctgtcagcctcccaagtagttgggatcatagaccaaaatcttcgaatgcattggaaatacgaaagtagagtgtctcttgccctcctggagtttgtgatctagttgctagtgatgaaggcaaagtggatattcagagaacagagtcagaacttcatctgggatcagagcttcttgtgttcactattgctgggcccaattgcaaatgagactagtatgatgtccc

SEQ ID NO: 392336 - DNA, 721 bp, Homo sapiens
tcccagttgtcagtttatagaaatatactctcatcaaggtagcatcatcttcaatcaaaaatatctcaaaagaaaatagtagtttaatgaaaatttggaaaaaagtaaaacagatatccaaataatgcttaacattaattaattaaggcaaaaatatgaactcccttacatgcgcacaaacaaaaattttaatttctttaattcacttccaagttttttcttttggaacttctactagtctatttttctaaaggttatttcaatttaattgtttatctttttaagcaggagaaaaagtaataaaacaataaaatgtatttatttataagatgtatctacattacatgtctaaagttagagctagatatttaacttggaaaatttttctattattttctaatccacatatcagcataaaattaggacatctcatttattatttctaacatttataatatgcacagtttactaataaaatttcagaatgtataaaagagaagtactatttaacacaacaatgagaaaaaaattatgctttagcagccctccagaattgcagaaatcagaattcaactggttttacattacagtagaatattttacggaaataaatattagtctacataaatctctaatgagtacattacaatcagcagtgtatagtcatgaaaataaaatgttattgatgtgcctattgactatgaatgtaatgatagaaaag

SEQ ID NO: 392337 - DNA, 521 bp, Homo sapiens
tggtcaagggaggccatcatcatagtagctttgaagaaaagacctatgagcaggcctgaggctctctggataaggccatggtgtatcgcagagaggaggagcaatgctttgagctacgacatgtcagtactagcactagtttgctgtgtgactttaggcaagtctctctccctctcagaaccagttttcacatctgaacttatgtggtactgtagggataattgcactaaagacacttctacaaacacttcctaggattctataatcctcatcaaggctgtcctcagacaaaactgtgaagttggcaatagttccagttttcttccttttctggtgtattttcctccactaggtggtgcctgtgcctgtcaccctcaggggccaagtgtggacacattttcggcttccacacctcagcaacactggggaaaaaagaagatggtacaccttcttgctaagtaccattgactggtaacaacttggaatgttactgctccattggtggatactcttttaggact

SEQ ID NO: 392338 - DNA, 368 bp, Homo sapiens
gagagggaccaggggcaaccagctctccccagaaaagtgaaacagagggagaggtgacagagggactccaaaatgtcagggctgggaggcctcgcagacccctcagtgccctgtacaggggtgagaagccaggcccataggaggaaagaggcttgcttgctctagatcacacagggagaacccacagtgagagcccacagcgagaacacttcgcctaggactttcccactagagcacaggggaatgactccaagaagggagtccagtcgttagtaggagttctggaggagggttagcacctggggggctctgggagcgctggaggagggagtgagaaagggaagcagaggggttctttggagagaatg

SEQ ID NO: 392339 - DNA, 397 bp, Homo sapiens
cttcaggaagaaattgtaatgcttttaaaatactccctatattctattcattaagaaaccaaatccctttgatgtttctttattttcaatgataccagatggtcttggtgtctgtatactcaagttggagaatttaattaagagtttataggtaagggttcagcaaatttcaaagctagcatgcaaattatttattttggctaaactgttatttgctgataaacatttgttcccccagaccattgttaattggcagtcttggtatgtagctcatatcaggccacatgtagagtatgtagatgaatgtgaaccaactagagtgaactcagagaatggaaaccatatgaggtgtttgaatgtcatgaggagtggctagaggtactgagaagcctgcttg

SEQ ID NO: 392340 - DNA, 623 bp, Homo sapiens
cccatatgatccagcttggttgcagtgagccgagatggcgccactacaaaacagcttgggcgacagagtgagactccccctaaaaaaaaaaaaaaaaaaaaaaaaaactgaaagcagagacttgaacagatatttgtaggccaatatttacatcagcattattcacaacagtcaaaagatggaaacaaaccaaatgtctaccaatgggtgaacagatatttccataaatgtgttatatgcatacaatggaatattattctacattcaaaaaggaataaaattctttgacatggtacaacatgaagtttgcaaacattatggagtgaaatatgccagacatcaaaggataaatatgatttcatttatatgaagtccctagaacagccaaattcataaaagacataaagcagaatgattaccaggaagtaatgaggagttagtgtttaacgcatacagtgttgcagtctgggataatgaaaaaagttctggaagtggatttagttggtgatagctgcacaacagtatgaaggtacttaataccactgaacagatgcttaaaaatggataaaatggcatattttaccacaacaatttaaaaaatcaaacatgtagtactcaaagta

SEQ ID NO: 392341 - DNA, 531 bp, Homo sapiens
cctctttaaaaggcaaaagttgcttcacccctaaaaatatacccagatctgagtctgagaaatgccactctattcaaatgactgcaaaacgtctgatcacccagcaccccaagacctcatgtggcctttatctggcctcaaccccaaacctaagcgcacaccctggcactgacgtctcctggcagcatttgactctggtggcatgcaggatacgcttctgactaaaaagtctcatcactgacttgaaaacacattacacagcctcaaagaacctccaaccccaagacccttggggtcacaacattacacagcctcaacgaacctccaaccccaagacccttggtccacagaccccatggattggagacaagctccttgcgagggcaccccagggccttcctctgcagtccccaccactcctggctcagaagacatcaaaggtcacagctcattctgggttctgcatgccagcctggttcccactatcctttaggaacccccaccaccaccccgccgagggtcacttgagaa

SEQ ID NO: 392342 - DNA, 158 bp, Homo sapiens
ggatcacctgaactgggaggttgagattgcagggagctgtgattatcaaagtgcgttccgcctggtcgacagagcaagactgtctccagagaaaaaagtgagctcccagccagccctgagagtcgtattctgcacctggtagacatcctcatggtgct

SEQ ID NO: 392343 - DNA, 423 bp, Homo sapiens
agaagaaaaaccaggaatacgtgttggctcttctgtatgctaatgcatgtaagagctattacaggtgtaaaaagttgcttagttgcacacattctctctcccttactcagtgtttcctcagtgtatactatgtgtcagccactcttttaggtaagcatgtaagaaaatagctgagtaagatatgaagacaaatgctgggctgctaagaacttaagattagtgagaactgagcataggctctgggtatcttgacaagagttatagggatgaaggatgaattggagggggcttaaaaaaggaagagagaggagactccacgagcacagataactcttttagggtgtctgtctgtaaaagagacacacacacacacacacacacacacacacacagacattccccttgttttcacttctgctatca

SEQ ID NO: 392344 - DNA, 372 bp, Homo sapiens
agcggggaacaatcacttgggtgagatcatgcatttcttcacactccagtatatcatcaagatatgcaaataaggactgggaaatgccctcacagtatccaaggattcctctctctacacctgaagggagacttaactggagcatcagtgatacaaatgcccagtaacagcaaaggcaaagatgtatcagccaagccatgggctatcagggcccctatccatattcccaaagcttaaagtgaaagcaaagtctctcgagaaaataaaaacagacacctctccacagagctgcctttttggggagagaatatcttgtgaaagtttcgcctgacagttcacatggactgactacagagtgaaaacaagtcaagt

SEQ ID NO: 392345 - DNA, 236 bp, Homo sapiens
tgcccgtggtggagcctaggagaggcccctggctgggcgtggcgttccagatttcacggctgctctttcccactgacagtgtggtgtggacgctgccaagggagtctggagccccagagggtggaggtgcaggacttccaggagcgtccgtcgcactccacccgagggcgagcacctcagtggccgcagtgggtggatgcatgctgtgccaggctgatggctggccccggggcaca

SEQ ID NO: 392346 - DNA, 506 bp, Homo sapiens
cttcatttcttttgttgctgggtactggggatttattttggtccttttattgtgtcatgtttcctgagtcttcaggttccttgtagcttgtgttggtttctgcacatgttaataaaggtcaatttgttcagtctgtgtaaagattggctttaatggggaaaaactttaaccaattaacccagaacgaaattctaggaagttctgtaacctttcctacggatgtgtattctctgaacttgtgtgtgtaggttcttaattacaggaatttgctgccctttgctttttcaaaggcctgtaagctctcgcttcttcttttatgagactgtaaaccgtaggtcaagacattggcagcacactccactcctttccttccttctgtgtggagaatatataacctctgcactttctccaaattttacagagccatgcggggtgtagaaagctgcaagttctttttccttcattcttagctgtccctccaaactataccagttttgtcagcattc

SEQ ID NO: 392347 - DNA, 246 bp, Homo sapiens
cagctcctcaagtgcaatgtccctttacaaaaataaaagttcatatagattgcccttactatcctaaaatcatatccttttggaagacaagaatacccaatttaggggcatgactaaagaatgtctatccatgggggaggagtgtgtgatatgtatgcagtttcctgaccacagctacgtggctggcctcctaagtcttctgtgtttcagcagttttcaagtaaaaagctatgattaccttaagca

SEQ ID NO: 392348 - DNA, 776 bp, Homo sapiens
aataataaaatgaaataagaatcaaataacacatgttgaagggacagagcaagcttcacaaccagactcagagacagcagggatgctggaattaccaggcgggaaattgaaagcagctctgattaatgtgaggggctgtaatggataaagtaggcagcatgcaggaacaggtgcgcaatgaaagcagggagatgggaatctaagaaaaaaccaaatgaagtgacagagagcaaagcacggtgacggaaatgaagaatgccgctgatgggctttgatggatttgtggactggacacagctgaggagaggatctctgagcataaggttatctcaatagaaacctccacatgtgaaaagggaaaagaaaacccacccacacgcacacgcgcgcacacacgcgcgcacacacacagaacagaatatccaagaactgtgggacatctacaaaaggtgtagcatgtgtaatgggaataccaggaggaggagaaagaagaaatacttgaaatggtaatgacagatttctccaaattaatgtcagacactaaaccacagatccaggaatctcagagaatcaggacaaatgccagaaaaactacacctgggcatatcattttcaaactgcagaaaatcaaagataaagaaaaagtcctggaaggggccagagtgaaaaaaacacattacctgtagaggagcaaagggaagaaatgcacctgacttatcctcagaaaccaggtgagcaaggagagagtggagtgagatgtgagggtggagagagaa

SEQ ID NO: 392349 - DNA, 242 bp, Homo sapiens
tttatttttaacttttcttttctcttacactgaatatactgtttctagtaacactattatttaaaaattagtataccaatattactactgagtaaatattattataatttctttgcaattctttttgttcttaccatatcctaataagtatatacagagtactgtgctctacaattacctgaaataattttctctgtctttcttttgtgctttctttttaaacattttgatacagttatgat

SEQ ID NO: 392350 - DNA, 265 bp, Homo sapiens
atgcacagaaaaatggctcaacatgcttaatgactagaagaagtctagaagcagcaagaaggtaatgtggagaggggaggacctccatgggacttccatgaccggtatctgcagagccaggggtacaggcacccagtgctgtggactggcaccacctctcagagggtgggtagcacactgtccttacctgggggacagcaggcctggtcaccagcttttgtacctgtctctgcaagcattgcattgctggaagagaatctcatgc

SEQ ID NO: 392351 - DNA, 562 bp, Homo sapiens
gatcttttctttaaagttaagtgagattccccagagaaagctcccccagtccactgttcagagggggtgagtcccgctgccagagttctacggctgagtgggagagaagggctgggctgtgggatccttccccgaagctccctattctctgtgtgctgccagtgccccaactgtgcagactgcccccagtctaggcacctgtaactctgtcctctcttgacatgaaaccttggaatggaggggaaactgtgacgctcccttggccgaggggagagggattctcaataactgcttcttgaagagacttcaaccagcgctcctgttttcataacccgctttcctgcccccactcctgtaagtgcgcaaggtcactaaggcccgaacctttgggtgattccgtaacagtgtacactcggtcaccttccagtatttccatgatgtcttagcatttgtttttctctcatgctgttaggcactgatcattcatcagctttctggcttctgaaaccttgttgctgtcatcctcttcttgtttcctttgtccttgtgggattatgcttta

SEQ ID NO: 392352 - DNA, 707 bp, Homo sapiens
gttcatcgtgcttgaggtttgttaaatttctctgatctctgggtggaattttttctcaaattaaaaaaatttcaggtcattatttcttcagatttttttctgtttactaccctatttacctgtctctagcccttctcttctggaatttcagttgtgtatatattagcctgtttgatattgtctcataagttactgattctgtgctcattttgttatctttcagttatttttttaactttctttgtatatagtgactattttaaagaatatgctaattccatcatggtataatctctaaatttatttcagttgactaaagtatactcttgttcatgggttacatttcgttgcttgtttgaatctctagtagttattgactggaggtggatattgtgaattttgggttgttctgtggttcattttgttgtcttcctttaaagaatgttggatttttttcctggcagttatgtaagtcacttgagaattttcttgatcctttggaggtttgtttttaagtcttttagagcaagtctggtgtagacttcactctagggatagttaagctcaatgttaaggtgtgaccgtttcgtgtctcttccgaagtacttcaggtgtgtgaagaagaagaatcattctggctggtcagaacttgaagatcactttatttgatctcttggaatttgatcaattccaagagatatagctcc

SEQ ID NO: 392353 - DNA, 450 bp, Homo sapiens
atcatttattcctcgatgtctgctttaaaaagcaaagtcatatttatgtcttccaatgtctattgcaaagaaaagtaaacacgaagaagaattttgcttgagtccatgctttgccgctaatttattgagtgataaaagtaaattctctcactcttagtttcttatttgaataataggtataaataatgtctcccctcgtctctcaacagattttctttattagatttagaaattatatggcatatgtcaaaatcatgtacacagcatacatctttaaaatcaatgacaatatttagttccagtggcatgatagatgtctcagtaaggtaatgaaacccttgctgaagtgatgctctctgcaactgcagctctagcttccccatcggatgagtcggtggaatgcaggggatcacagaaagcaggtagcacgcttcccacacaggtgctact

SEQ ID NO: 392354 - DNA, 311 bp, Homo sapiens
cactttaaattgcatcccgtgctctgcaactgctcctggttttcttttggcaagacaatctcactctctttgcccaaactctgaagtattacaggcaccagcaatgcggtcagtgcaggttaagaaactgtaatgtgccatggtttactccttaaactttcttatcaacttttttcccttctgtttcatggtactttcaaattgcatttattataaagcaaatagaaagtgtttcacataacttctcccacaagcaattttaatgagctttggctttagtaatggttttaatcatgttagacttgatcttc

SEQ ID NO: 392355 - DNA, 430 bp, Homo sapiens
cagagtccaaacagtgctcagagtccaaacagtgcccagagtccaaacagtgcccagagtccaaacagtgcccagagtccaaacagtgcccagagtccaaacagtgctcagagtccaaacagtgcccagagtccaaacactgccttgagcctgcgaaatcaaagcttcagtgagctatgatctcgccactgcactctagcctgggtgacagagtgcctggggtgctctctgggtgctcacccagaatgcctgggtgacagagcctgggggttaccacccccaacccacctctcattaaaaaaaatgtgctaatacgatttaaccttgtatttcagtatttaagtcacgatttaaccttgtatttcagtataaccttgtatttcagtatttaaccttgtatttcagtatttaagtcacaggatatcaaaag

SEQ ID NO: 392356 - DNA, 177 bp, Homo sapiens
cttgagacatttggcatagatatgcaaaggcacgtgaggcatttcttgcttgcatctgcttagaatattttggggagaaaagatgtacacaaatctgtgtggcacaaaccagcagatttattattattaaatagggccttattattaagggcctactcaatataaagtgtcttaggg

SEQ ID NO: 392357 - DNA, 210 bp, Homo sapiens
tagcctgagtgctgtcaggctaagaaatgtccttaggtgaccaagtgtgtagaactggtcataatattttaggagccactgactccttaaaaaaatctgatgaagacctggcacggtggcacacgcttgtaatcccagcactttgggaggcttgagcccaggaggtggagagcagcctggccaacatggtgaaaccccgtctctactaaa

SEQ ID NO: 392358 - DNA, 747 bp, Homo sapiens
gagatcaacatttattataaattttctataattaatacagtgtggtattcgctcaggagagaaaaaatagatcaatggaaaagaattgggagcccaaaaacagatccacatgtatacagtgagttagtttattagccttgaaatatgttggagaaataatagtcattttaataactgatgctgggttatcagttatactgataactactacttaacactacttaacactagctcttcatacaactacaggcaataaatacaaatagcatgcagctggcagactgggcccagtggctatgcctccactagactgcccatagaagcataataacagctaccgaagatgtctgatctgtcttgtcttttttttcaggtataatttacataaagtgcagactttaactacatttaagttttaacaaatgtacatatccttgtaaataatgcccattcaacatgttaaacattttctttaccccaaaatttcccttgtgcccctttcccttcatttctttccaaaaaaggatataatcactgttttgctttctatcaccatatgttggttttgcctattcttgaactttatataaatgaaatcatactgtaatatactcttgcgtttggcttttttttcattcaacatggttttctaaatttgtaatttataataaatagagtattgcatattttattattgtttataaattgtgttctgaaaacattctatattagtaaaatttatagtaa

SEQ ID NO: 392359 - DNA, 368 bp, Homo sapiens
acacacacacagtcccaggttcccacagtgtaacagaagttagaggtttttgttctctcctggttttgctacacacagaaagatggactcacccatagcctcaaagataaggccaactttgtttctagtccctatccactgaactgactcccacaaccaaatggaatagtctttaaacctgctgggctttaaaattctgtgagataatcctacaagctcccgcctctagcccccaggcaaattcttccagaagaatccaactacccatgattaaactaccatgaaatattaatatacaggcttacctaaagaaactagcattaggctgggcgcagtggctcacgcctgtaatcccagcactttgggag

SEQ ID NO: 392360 - DNA, 612 bp, Homo sapiens
tgaaacctcctttgcaaaaattataaatgaggaaattatggcagtgaaagagatcagacctaatccactccatcctgcttctaacctttaagccatctttgttcattcctagctgtaggctgaactagccttgggaaggaattcagttcatggtttgactctgaaacaaaattgataatagcgctttccccaaaagacctccttcttgcctggggaccagtctgcctttgtaggactaacaaattagctacaagattagaaattatggtttaggggtcatgcagcctctggctataagagtgggaacctcccctattgcttctagggataacatcactattgcgaaacctgaaattagtgcttgagatattttgtagaccctgcacttgatggatcagctgataccacctagactggcaatctggctcaaccagttctgtgatcccatccaggaacagagcacagcaagaaaacctcacttgatcccctgtgattccatctccaacctgaccaatcagcactccccactttcctgagccactacctgtcaaattatctttaaaaactctgacctcccccttccatgctcagagagactgatttgagtaataa

SEQ ID NO: 392361 - DNA, 1142 bp, Homo sapiens
tgaaacctcctttgcaaaaattataaatgaggaaattatggcagtgaaagagatcagacctaatccactccatcctgcttctaacctttaagccatctttgttcattcctagctgtaggctgaactagccttgggaaggaattcagttcatggtttgactctgaaacaaaattgataatagcgctttccccaaaagacctccttcttgcctggggaccagtctgcctttgtaggactaacaaattagctacaagattagaaattatggtttaggggtcatgcagcctctggctataagagtgggaacctcccctattgcttctagggataacatcactattgcgaaacctgaaattagtgcttgagatattttgtagaccctgcacttgatggatcagctgataccacctagactggcaatctggctcaaccagttctgtgatcccatccaggaacagagcacagcaagaaaacctcacttgatcccctgtgattccatctccaacctgaccaatcagcactccccactttcctgagccactacctgtcaaattatctttaaaaaacttctctggactttcccctcttcacaggctcaagaagaagatcggatcgagatgtaatatctaaaatcttcgggtctccaggcaaaacacagacagcgaaaccagcacacaagaagacgcaagaccagtgtgtgtgtcgggggcagcagcaggcgcctcgtgaaaaaaaagggcttctgctaagagacacagtcgcgtggggtggacggggggggcccccagaggagggactcaggcggcaaccagtgggcccaaacaggcggggcccccaaggagaaccaccgctgggcagaggggaagacagagggtggactggggaggtccccatcccaggcagataaggaaaagaaggcgcccccaggaggagggagcaggcacgcgagagaggccgtagcgtgtaaggaaggacagcgccgcgagccagtggggacatctgaaggaaggcgcacactaacaggaggcggagagcctacctcaaacaaaacggcggggaccacagtctcacaggagcgacagagcctgcggagaggtacaacaaaagttaagcgcccgcgccggagtagcgggggtgagcgg

SEQ ID NO: 392362 - DNA, 338 bp, Homo sapiens
cttaagttcttattatagcaaagcatatcactcatgtagcaaactatataaatgtttagaatcatttcggagctacatagcaggtatacctgcattagacaatataatggataataagattcttacacctacttataattagtaagtttggaatgttcagcaaatattggaaacgcaggggtagtttgtctttctatgtaaaatggatttcatttctatgctcagttaattataggattttcatttgcataaggatgagaagtataaatatttttggaggtataacgtagattgtgagacagtgaatatgatgagtaggattggaagagtaagggcaa

SEQ ID NO: 392363 - DNA, 184 bp, Homo sapiens
gagttgactacgcggctcgatctgtacgcggctgtctcagagatctgatggttttataaacatctggcatttcccctgcttgcactcaatccatcctgccgccctgtgaagaaggtgcctgcttctcctttgccttctgccatgattgtaaatttcctgaggccttcccagccatgcaaaactg

SEQ ID NO: 392364 - DNA, 240 bp, Homo sapiens
tgctcccccacacatacacacccttttcattatgtgccaaagatcactttcccaaacctgtttcggaacagctggccgcactagagggcctgcatgggctgggggaggctggggttattaatagcatttgctctgcccggtgtttggggcaggaaaggggtgatttgcgtctttttggaaggctaggccctcatcagtttgggcctgatttttctgcgctggatcctttaaacctcaggg

SEQ ID NO: 392365 - DNA, 459 bp, Homo sapiens
cagaaattgaagcttaaacttttatctaatcttgttttaaccttctgagaagactgtgtgtccttagtgactcagatttagcatacaggtgatgagttgtctcatttggtggccagtacttactttttgtcttattaggttgaaagctatctcttcttgagaatgctggtgtatgtggctggtaacagcttgccatttttgtttagttgcttttactttcctgaaacccaggaagccagataattaagttttaaggattatacgatatacaagtcaataattttctaacaagatcttaaaagcacagtatattgctttggtacagtggctttatgagagctttttgaactgtttagagtaggggtgtccaatcttttggtttccctgggccacgctggaagaagaattgtcttgggccgcacgtaaaatacactaacactaatgatagctggtgagcta

SEQ ID NO: 392366 - DNA, 419 bp, Homo sapiens
cttgctgtggtcctcgtcgcacacccagaactagagcactgaaccctgtaggccagaaaccatgattgactgatatgttgaatccagcactaagcctaggactcaataagtaactgatgaattgaactaaattaagcataccttgtttggtcaatctgcaacatttctctcaaaattacttacaactctttcttgagaaagaaagagtcttttcctagccaacccagcagactgtctgacttaagaccatgattgacagacagaagaacgtggccagaaaaaaatgcaactgagaggattaaatgaaatataactagggatgagctacttttgataataatctggagcggggatgaaagtagggaaaacggacttagacggcccattgatcgctgttgatggtgggtgatggtgacggc

SEQ ID NO: 392367 - DNA, 225 bp, Homo sapiens
ggaatacatgccaagtattttttttaataatagatacttagaagtaggattaactgataagatatcagcatttttaaattttaatagaaactgccaaattgttctccaaagtagattattcaatttacactcccaccaacagtctttgagatcccacgttttttcctcaaacagccttatgttgtcatcaatttccctgtactagttgtcaatgccttttttccc

SEQ ID NO: 392368 - DNA, 281 bp, Homo sapiens
gacatggtttcaaatgtattgataatgttttagttcttaaacatactaccattctgaagcaagtataggaaaatgttaaagtgttctctatctgtaagaatataagagtttattatttccctttaagctttttctctgtgtttgaaagattttattaaaaaatagaatgaggccaggcatggtggctcaggcctgtaatcccagcactttgggaggccaaggtgggcagatcacaaggtcaagagatttagaccatcctggccaacgcattaaaccccaac

SEQ ID NO: 392369 - DNA, 314 bp, Homo sapiens
gcagggggtcgggggacagagttttgctctgttgctcaggctaggatgcacaagtgcgatcttcgcccactgcaacctccacctcccaggttcaagtgattctcctgcctcagcctcctgagtaggtgggattacaggcacccaaaaccacacccagctaattttttttttttttttttgagacaaagtcttactctcttacccaggctggagccttcaaatatcctctctgaaccctcttctactttgctcactatcgctccccctaacatctgctaacattcattcccactagatgccagagtccaggtgtg

SEQ ID NO: 392370 - DNA, 163 bp, Homo sapiens
gacacagctaaaccatatcactgggtttctaaacgagccgccaaatgtaattctcagagtcttcacttcaaagacaaggtcattaagacatgtgcttttggcacctcgttcctgcctctggtgcatgacacacaattggttttttgctctttttactcatttc

SEQ ID NO: 392371 - DNA, 912 bp, Homo sapiens
acaatttctcctgactatacattaatcattcatctagcaaatacttcctgagtccttacaatgaaatataagttaggtatacagacaaaaattcctgctcttgtgaaacatcttagtgaagggagacaaacagtaaacaagtaagtaaaatccatgtatgtcaaattttgagaaggaatttggagaaaaatcaggaatagggagtaccagagaagggggatggaattgcaattttaaatatggtggtcagcgccgggcgccgaggctcaggcctgtaatcctaacacttagggaggccgaggctggcagatcacttgaggtcaggagtttgagacaagcctggccaacctgatgaaaacccttcactaaaaatacaaaaattagccgggcatggtagcgcttgcctgtaatcccagctactcgggagtctgagacaggagaatccgttgaacctgggaggcagaggttgcagtaagccaatatcgcaccgctgcagtcagcctaactgagggagcaagaccccatctcaaaaataaatatggtgaccaggacacctttgaaaaatctcggattatcagaaatatatattcttctgtctagtgaaatgtaaatatatccagtagaatagaaaaatttggcctggactggtggctcacgcctgcaatcccagcacttttggaggccgaggcaggcgggtcttctgaggtcaggagttcaagaccagcctggccaacatggtgaaaacccgtctctacaaaaatacaaaaaaaaagggggcgcttaaaatcccggagggcaggtacgtaccagtttgacaaggccaaggaccgataaaaagaggggacaaaaacgaaggaagctggctgggactcatcgggaagacacacaaaacggaaggaggaccagggagga

SEQ ID NO: 392372 - DNA, 458 bp, Homo sapiens
cacctggtggcctcagtatatgtctccctaatagtcacagttataaaacatttggcaattattatcactcatgaactctattttactctcatacaagccagtgcagtagcttgcacctgtaaccccagtacttcgagaagctgaagtgggaagattgtttgacgccagaagtttgagaccagcctgggcaacatggcaagatcccatctttacaaaaaataaaataattagccaggtgtggtgatgtgatctgtagtcccagctaattgggaggctgaaacgggaggatcccttgagcccaggaggaggaagaggctgcaatgggatatgattgcaccactgcactccagcctgggcaacacagcaagattccgtctcaaaaaaaaaaatataaaaacacccccaggaaggaaaggcgatgtggattaaaacttcctccggctggagctaagggcttc

SEQ ID NO: 392373 - DNA, 156 bp, Homo sapiens
tctctcaggacaattcccttctgagatgttgatacgtgcaccactctcctcgcgcatcttcttaactgattctcctttctttccgatgatactgccaacttcctttccatgcataagtagtcggatggtgagagtgatatttaatccaccttcaat

SEQ ID NO: 392374 - DNA, 237 bp, Homo sapiens
gacgaaacagagatacagaagagaaacaggggaaaaggccaagtgacaagggaggcagagactggagtgttgttgccacgagccaaaaacgccagggaaccccaggcaagcaccagaagctggaagaggcgaggaagggttcctcccagagccttgggagggaacgtggccctgccagaagtcacaagtcctggatttaggatttctgccttccagagctgcgagagaccgagtttc

SEQ ID NO: 392375 - DNA, 356 bp, Homo sapiens
tccaaccgtaggctaatgtaagtgttctgagcacatttaatgtaggcaaaattgttataatattcagcagatttagtgtattaaatgcatttttacttacattttttcaacttattatgggtttatgggatgtaatctcattttaagtcaagaagtgtgtttattcaatgacttgatatagattctgtattagaaaactgtattttagcaatgtattttagcaattcccaagtgtaccaattatattatgcttaggtaagggtgtgtctttgttcttaagagacacacaccaaagcatttaggcatcaagtgttatgatgtctatagataattccaaagtgtgataaaaactaata

SEQ ID NO: 392376 - DNA, 308 bp, Homo sapiens
gggttgatgggtgcagcaaaccatcatggcacgtgtatacctatgtaacaaacctgcacattctgcacatgtatcccagaacttaaagtatatataaaaaaagattaaataactcccttctccaaagtgatgtccccattgtagtcaagatactataataattatagcatttcttgaactctgactgtatgccgggcattgagtataaaagggtttagcaaccctgtgaagtagttgtcatcattcctattccatagatgggaaaactgaggcactgagaggttagggaattttcccatcataacact

SEQ ID NO: 392377 - DNA, 286 bp, Homo sapiens
gttacctgcagagtgaagaatgagtggtactcacactggtttactatatttatctcactattacattctatgtggtcccaaactagttctctcattcacacaggcagcaagaaattcttcactagtcctaataaaataaaagacaaaattgcagcggaaagatatatcaagacagtaatctattggtttagatagatcaaatgcctgactatattgtttatgggaaataagtgttatccctactcctcacactttgctgttttctgaaatggatccactttgagat

SEQ ID NO: 392378 - DNA, 341 bp, Homo sapiens
actaggcgcactctggtgggtgaccgacttcgttacacgggtttaaagtttatttttatggtttagtcattgcagagttcttattttgcggggagggaaagggggccagtccccttcttttggccctccgcccccgcaggcttctcttttttttggtcaaataccaaatgcatgaactttaccttcctaaaaaggatggtcttcgtaactcaaacattttttaaactgtggtttctgccacgaattttgaaaaatcaattttagacttgaaaactaacaatttgacattttctttgctgtttttggctatgtaggccttttcctgaagcaaaaccatggtc

SEQ ID NO: 392379 - DNA, 453 bp, Homo sapiens
tcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtc

SEQ ID NO: 392380 - DNA, 651 bp, Homo sapiens
tcatgcaatgtggtcgctgtgccagggacactcttctgtcctctgcttacatcaacccattgatgaatcttgacatcactgaaagtgagacagcagatacttgtgcctctttagggatacagtaagaggtatactgcgtcacctataaactgttcttgccaaatacattgaacctgaagtgcagtcaagacttcagatctagctacatgcttataggaaacacagcagatagagattaagtgatacaggaggagggaaacaacttgatccagaatgtgatattctgccaaagcaatgacctggtttcttcaacaaatcagtggcatgaaaaaaagagagcaggggggaaccatgattgttcaaaaatgacttatgtgacatcaaccaattgcaatgtggtcctcttttagataccgattcaaagaaactgactttaaaaatgtcgggagtttttttttgcaattttttgaggaaatttgtatatagactgggtactaagattgtcattaatttgctaggtgtgatgatggcgatgtggttatacatattcttaaaataccttttctattagaaatacgtatggaattacttactggtgaaataatctgatgtccgagatttgtgttaaacgatgtcggggtaagaggaaaa

SEQ ID NO: 392381 - DNA, 699 bp, Homo sapiens
agactaaattcttcaaagtaaaataacgatttcaaagagaaaatccattctaaatcatttgctatattgtgccaaccaaaaagactacttgtattctttttaaaattttaatttatttatgtattcctatatgtattcaaaagactgatttttaaaaaatccttcccaaattgcaaaatacccacaacgactaataaaattcaaaatattttattattattacttgttgcaactttaataagtcactacattttaacaacatttgatgaaaactttctcttgatcaatgacacttctgaaacatctaccattttgatctctgatgaccttttaatcagtgagcatttcacacttgataacacttgattactacttggacaaattattgatacaatgacctggaaattcacaagatttctcctcaaatttgaagaagtcgagtttatttttgaaaggtttatttatagtttactttaaaaattacatttaatctcataaaaaatgtggtaagatagaatatcatggaatttgagctttttgttttgatgagcagtctcaactcacatatctatactaatgcaagtaaaatacaccttacaaagttcaaaaattcccaattacatatatttaacttaggaatgaactatgtgatacttgtgccatattgcccttataattatatttttcttacactaaatt

SEQ ID NO: 392382 - DNA, 408 bp, Homo sapiens
taccttggctcagaaggctgcccaattcgcagttcattctttgttcagttaaactcctttaaatttaattcagctgaagtttttcttttataccctaaaccagggcttctcaacctcagcactactgacaactgccacagacaatcctttgttgtgggaaactgtgctataccttgtaggatgttgagcagcacccctggcctctactagatgacagcagtatctcctctgcctccagttgtgacaaccaaaaatgtctccagacattgcaaatgcctcctcagaggtgaaatccccccagttgagaatcactagctctagacccaatcatcagtacctgcacccactccagaatcgtagtttcaggcttctctactccctaattgaccacctcttagctttccaata

SEQ ID NO: 392383 - DNA, 715 bp, Homo sapiens
ggaaaaattaagaccataatctatccttaattcagttgtaccctaaaagaagaggcttataaatacgcaaacttcactaagtctaaagctgtaatttataaaagaaaaaaatacatgtttgattccttggctgaagagagctggggctgagagattcctccacattctcacaagcaggaccaattggaaaagcagacctgacaagcccttgtgaaataaggatttcaggcactgttaggtgcatccattttcattcagacttcatccccaggagctagatagcaaatcctcacttttataatgcagaactgaagcagagtagataacaaacatgaccaaggtcaaacaagtagtaagttatgaagctgggtttcaatcccagaaagacgaaacgactgttagctgtatgtgacctttgaggaacagaatctcagaaagcttttctcttgaagtggagctagcaaaggagagaaggagcacagaggtttccttggcaggaaaggagggtgcaaaggcttcagcaggtcaagggtatgaccattcacagcggacttcagtaaccagcacttgaggggaaaaacgtcaacttcggtaagtagagaagcacatttaaggttctgatgtaccacagcacacctataaaataagcataaatcaatctagcacttctagggctttgggtagagaaagtcatgtcacttaacgacggggatac

SEQ ID NO: 392384 - DNA, 578 bp, Homo sapiens
agtgaggggtagctgctgctgctattgatgaaggctgaaagtccttgggcttccttctgctctggaattgtgtctgtgtttctgcacagtctctgtgggattctacaccttgtgttttcatctcagaacaactttatgactctaagttctggcagaggtaacttaagggaaactcatacaagtaactcacttttttttgggctcagtgttttacttgataaatgagactggtcccttaattactttgtaggaatgatgtgttttacttgataaatgagactgatcccttggttactttgtaggaatgatgtaaggctgcgggactaatcatggtggaaacatttccagagagtggataattttcctcctttttctgttacttgccattggctatttatgtatgtatgtgtgtatttgataattccacctttggctatataagatatatataagatatggtaatcttattaaaagctaagtcttggtatgacatttatggacacctttggggtaccaagattgctttgtttctccatcaaaagagcctgttcagttcatatacactatgtatgtgatca

SEQ ID NO: 392385 - DNA, 463 bp, Homo sapiens
cagaatgtggtaggatgttgcgagatttcatcatgtcaaaatggcacaaaatttaaaacttacgacatttatttctggaattttccatttaatattttcagaccatagttgaccttgggtaactggaaatgtggaaagtgaaaccatggatggggagggggactactatattctcatccagcaattgagctcctttgtattcaaatgaattgaaaatctatgtccacataaaatactgcacacagatatttataatagctttatttataattacgacaacttggaagcaaccaagatattttttagtaggtgaatgaataaactgtggtacatccaatggagtattaagcactaaaaagaaataagctattaaaccatgaaaaaacatggaggaagcttacatgaacgttactaggtgaaagaaaccaatatgaaaaagccgcatactttataattccaacta

SEQ ID NO: 392386 - DNA, 4944 bp, Homo sapiens
  misc_feature (4894)..(4894): n is a, c, g, or t
atacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccactggtatctataaacccttttcaggggagagaccaggagaccaccatcttagatactgtcaaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcggggggggggggtggataaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcncctttttaccaatactttttcattaaattatgaaaactgctaaaaaaaaa

SEQ ID NO: 392387 - DNA, 498 bp, Homo sapiens
ttttccggcacgagggttgtataataaaacagtctaattagcctagagccagggcagccctgtgggagatttcatacataatctagaaggaaagcaacgacaggcgggcttttcccactaggtctcaattccttttactaagtttgaaaagccagggggaagtgtccaacaaggacagaattcttgccaaggtgaatttccagctggcttgaaaaagcttgagcaataatggctgactcttaaatggggaatggacaaggttattaaaactatcagagtgcaccttggggcatttgtagcagccagagcgagctgtgaaactatgtagtggagaggtgaggaccccatgccaggtctgggtgaggaataaaaataaggatgccaggttcctgggggaaatgctgtttttcaagggtgacacagaatttctctgatacctcaagcagtgtacagaatttttagcccctggagagatttcagtcctgaccaaaaaaaaaa

SEQ ID NO: 392388 - DNA, 223 bp, Homo sapiens
ccttgagctttccatctggctgtctccactacgttcttcacattatagcaagactgacctggaaactacctggacgcagctgaccctcttgcctggtatccttcaatagcttcccattttccttaaagtcaaatctgaactcatcatactatccttacaagcctgtgtgatctgccccctgcctgtctaaacacagtttatgttactcatccaccaaacactt

SEQ ID NO: 392389 - DNA, 380 bp, Homo sapiens
ctgctttgcagaaatatttatggattattatgccataacagagagtaaatgcttgggtaaggaacaccaatatgtcaaaatgagctaaggtttggaaagaggttatctggagaaatatttacttttttagacaaaaagtttcaagatattgtcattcaatttaaaatatgtaataggtatggaaattaggggaatcctctaagcaactctgcaagttgtgcaaacttttagctctatttcctatgaaacaaagggattggactagatgatgaccaagattcccttccgttctgtctttgaattatgacatttgggttaaatactgcaggagtgtgtgtgtgcaaaatcctcttgaacaaattccctaaacagtccaaaac

SEQ ID NO: 392390 - DNA, 776 bp, Homo sapiens
gaggctggaacaggcaaggggccccaggctcctgaggctggactggggcggctccagagccctgtgattcatggcagcagctctctttctctccatcgccctgtcaggtcctttctgggcagacaggacacactgcagagggaaccaagtgacgagcttgtgaggcccctggtgggcacctccattgcctgggtctccgcggagcccctagctctgtctcctgttagcagagggggaagcccacttggaccaagcattcccacagctgctggagcgggcgcgtttcctgcgctccaggtggacatcgcttgttttctcacttaactaattattgctgattccagcgcgtggggacacacaaatcagaatcctggaagcctctgtcggtgactgaagatagacactgtcctgtcagccacaactccatgggttatacaccccggctgaagggtcacccggggctacaggagcaaggacagagaaacaggggaagtgactgaggagaagatgccttaattggaggtttgaaggagaagcagaggtgcatgagtttggaggaagcgctgtgacagcgccctgctttggggacaaagggcgcacactgtcctcctgggtctggctgtgtcccttgggcctgctcagagaggaagcgatttccttctagggtctgtgagtcagtcagtgctggggacagctgagaccctgcccagaggcaggaggggagcagccacatgccactgtgtccttgagtccctggggccatggctctggggttg

SEQ ID NO: 392391 - DNA, 676 bp, Homo sapiens
agtgtgctttaaaaaatgacgttatattagaaaaatggggaaatgctgtttttagatcatttttatctcctaataaaatgcaagtttcagccactgtagtacttgattaattcaaaatttggatttctttttcctctaaaacaactacttaaggcagtatattgaagtagattcagtcttctggtttttgaagaagaaaagaagtagagagggtagcaggtaggtttacgaatataggggcactatgtatggtgaattcatagactataaatcaaaacttataattagcattctcatgttatgaatcttaaatgaaacttgtgtttctatttgaacacctaataactttggtaaagtcagaggccatctatattacttcaccaaagtgagaatttgctactttttgagctcttttaagtctagaagtctgggctccaagccttcaaggcccatccccgggaaatagaatgggcagaagggagggagacaaaagaaaatagtttatatatccctaaatatatctggtgctgtcaaaaatgataattaaacttgctaaagtattcagtgtaatcctaaatgaaaaagagtataaatgattacacctctgtaaaataaaatgtaagtgtctatggaataaaaacagaaggaaataaatacaatgaaacaaatgattgtg

SEQ ID NO: 392392 - DNA, 191 bp, Homo sapiens
ggggtccctgacttcctgcaacagaccattattctgtcagttacgatgtagcatgtcaattatacttcttttaaaaagtttttaggaggctgaggcaggagaatcacttaaacttgggaggcggaggttgcagtgagccaagatcatgccactgcattccagcctgggcagcaagagcaaaactctgtctc

SEQ ID NO: 392393 - DNA, 292 bp, Homo sapiens
acaggaatacatttttttctttatgataaagatttactagaatcttattctgcactggcacaatgtcaaagtaaaattccccacatttatgatgctatttcttgtgatttcctgtggtaatagagttctccaaatatatacatgtgtcagaggaaaaactgtattcaaaagcaagtgggggccgagcatggtggctcacacttgtaatcctagcactttgggaggactgcttgaagccaggagttcaagaccagcctgcttaacaatgcaagaccctgtctctgaattgtac

SEQ ID NO: 392394 - DNA, 458 bp, Homo sapiens
gccaagccagctcactgatcattacagaaatgcaatcgaaacaacaacgagataccatctcacaccagtccaaatggctattataaaagatgtcagaaaataacagatgctggtgaggttgtgcacgaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggtttaaaaaaatactgattatatcacagtgtgactccacttttgttttctaaaacacattcatttcaactataccttaataaaaccagggaaacatatgtttatgcaccagcatagaatgaggcta

SEQ ID NO: 392395 - DNA, 217 bp, Homo sapiens
ggctgcatgcagggctggctgagcagcacggctgggagagctccaaggaaagactcagcagcagcagtgagtaaacctgcggcaggagggactcagagggacccgcttctggacatccccgcaggccagcgatcgttaggtgacgaaactggagatggagccgctgtccctgcagctccgtcgggtgatatcacaggtgtgctgccagacctcaccc

SEQ ID NO: 392396 - DNA, 332 bp, Homo sapiens
tcatttcttttagatccttctaggtgatagagctaggaaataaatttttttaagagaaaaaatatcttgaatttatactgctatttccagttcaaatttgatttgtgaggttgtaacttctttcattttacacttttttttttaagttgaaaatgtttcccagtattaacattaatataattgctttgggccctatctatgtgtgtgtggtgcacataaatatgtttaaaacataaatttaaagtaatatcagtgttattactgggtgaagtttaacatttctttgtagattctttttgccgttagactgttttctactgaagatagtaaaa

SEQ ID NO: 392397 - DNA, 223 bp, Homo sapiens
cagctgtgaaccatgtaggatgtgagaaattacaccctaatcatctatttcctagccatgaacagttcaacctcggaaaattctaagcccaggctcattagtagccagtaaaatctggatgttatgtgagtcatgaataagaccagagtagaatgaacaagtaaaggtttactgtgtatgtatgaagatagggtagaaatatatcggttttatttttattttt

SEQ ID NO: 392398 - DNA, 425 bp, Homo sapiens
gaaatattctactcccttggatttcttgactccaattgcccctggtttctctgctacttgcccgattactcctcagtctccatcattgattctgtcccccaatcagccttattaaatgttgcagtgcggtgttctgtcagagggctttgctgtagtttgaatgtgtcccccccaaagagcaagtattggaaacttaatccccagtgcaacagtgttgagacctaaggagaggtgattaggccacgccttcatgaatggattaatgctgttattgagaaagtgggtttgttatcttgggagtgagctccttataaaaggattagttagccccctttgtccctctcttgtgcggtctcttgtctgtctttgcccttccaccatgggctgttgcagcaagaaggccatggcttgatcttagacttcct

SEQ ID NO: 392399 - DNA, 269 bp, Homo sapiens
ggcttctctcaagttagtttgacatgagttataccctaagataataacagtggttatcactaggtagacagaataggtttaatgtttctttttacctctctgagttttcctggtttctgccagtaaacatgggttatgccgtaaaccttcccacttctgacacctggccttcacatcagcatgggacaccagaaagtgcctgaataagagccagcaaagaaaaatgttttcatttcttctagtgtaatttatacttatggatctcatga

SEQ ID NO: 392400 - DNA, 796 bp, Homo sapiens
cacttttccccagctttcttaagtcactgcgcagaggtgagaggaaaaaggaaaagtgatacccaaaataaaaggacatagtatactcatatgattattgtatcgcaggtggcattgcctttatgttcttgtttaattttttaaaactgagataacttgttaatcataatatagtacagcttgtacttgtgacctgaatttacttagggtgctgagcgtaattaacctgatggagccatgtcatctatcagtatggttggaaagagagaacagacctaagctctgaatgtgactagagcagaggaagctatgctgaaatttttttttttttttttttgggacggagtctcgctgtgtcgcccaggctggagtgcagtgatgcgatctcggctcactgcaagtatgctgaaatttttaaaacttgatagattcttcaaaaggccaggtgtttgtttttttggtttttttgtttttttttggtttgttttttaattgatgcctgtcacaactccagaaaattctgtttgtgtagcagttgacaatctaaaaaacaaatggtcttttccagacattctcaactgtcgtggttgttttgataacttgaaagcaaactgtttctagcacccatctcttgtccttcctaaggagaaaactatctcattgaaataaagaaaggcttgttttatgactggtgcctttctggactctcatttagttttttacactgacatcagcctcctcaagattggtcgtcttttaagcactagtttgtttcattatttgtaccatcaaaata

SEQ ID NO: 392401 - DNA, 859 bp, Homo sapiens
atctgtattagtttgatagggctgccttgacaaaataacacagagtgggtggctgaaaccacaggaatttatttcctcacagttctggaggctggaagtctaaaatcaaagtgttggtgggattggtttctaccaagcctcgctctttggcttgtagatggctgagttctccctgtttcttcacatgccctccctctgtgtatgtctatagcctaattttttataagggaaccagtcatattgtgttagagcccacccctagtgacctcatttaacctttatctccaaatacagttatattgtgaggtacagggattaggatttcctgtgaatttttaggagacacagtttagctcataacaaggttctcaaagagacttagtgtgtaaactagtgagactctgaggcagtgagctcgtattggaggctagtgcatagtctgagcattactggggtaatttgatgtttggcaagaaagggaagctgctatttgaggacaaaggtattttatctttggcctgaggccacttattttctttctctggatgttcattgggaaattgtgcctctgtggcctttttgtggacagagcattaattttttttttaagtgttttataaaagcattcgttttcttaaaatatttcttttaatggttcttaaaaatagtaaagcgctaaatttggcaaagctgaaacactgtgttgtaaatgtctcagtggtttttgagtctgattaaaacaacagaatttattctttaaattccattgatctaaaaactgtctgtcttatacgtgttttgtggggtaatgtatggcataatcttttttccttcagaaatgtttcccccttttgggaaa

SEQ ID NO: 392402 - DNA, 127 bp, Homo sapiens
aagggtctccagactgtgacacacacaactttcatgacaagagaggaaaaatgaagtcactgtttccctccaggcatcccagatgtctctctcttcccacccacctatgtgacagtgtctctgctgt

SEQ ID NO: 392403 - DNA, 377 bp, Homo sapiens
cctaccttaatataatgagccggagactctgagagtgggcccagcaatctgttttaacaagccctccaggtgattctgaagcatgcttaagtttgagaatcactgttctagtagtagtatagctgtggagctcctagcagatttcattctcaactgtcccattggaagaggaagaggcattttttactgccacttatgccaagattacacatactctttgtgtttctgccagcatgatttcattttttatttcagtgaaagtaattccagtaagttatagtttaatgcctagtatgtgcaccaaaatgagatatatgtgatttcatcttagctttacaatgacctgggagccttttggagtagatatagggggagag

SEQ ID NO: 392404 - DNA, 144 bp, Homo sapiens
ggatttgctggtgcagtacaactaggcttaatagggacatgtctgattacataaaaactgaaacttctgtataccaaaagacaccatagataaagagcaaacgcaagccacagactgacagaagacattttaacccaaaaaaaa

SEQ ID NO: 392405 - DNA, 251 bp, Homo sapiens
atgctgggtcacctgaaattgagggcctaaattctctagacttcgttcttcttatcccattaaaacacctactccttgaggcttatctcagcttggagctgacctaattaaaggaacagacaccaagctgtgaattgtcttgttggaaggcaagaaggagggtgaatgtagtgtgctctgtattcctaaaggggagtttaaaggtgggtgaagttggctggatgcaatggctcatgcctgtaatcccagca

SEQ ID NO: 392406 - DNA, 891 bp, Homo sapiens
cactccagtgaaagataatgagaaatagaacttctgcttacagaagatgaattttgaatgcctaaggtttaaatttagatttgatgggatagaactttgcatattatttacatggttttgaaaacaggcatgaagagagaacaaggttgtaaggagcttaggacagaagagaccaagctgtcttataattgagtcaggacgaagcacaggaatgttactttgaatcaatgctggccttaatggtccactgatctatgggagaagaaaaaaaacttgatatttaagcattggtggaaaacacacacacacatacaaaatttctgaataccagagactgagggaaatttgtacccaacctaattagttgaaaatacaaagcaagtttcatcaatatagcttgtatagggttaagaaaaatacttaagcattacatgattgctgtaggagcccattttttggaaaatttccagggactctttgagtcaacttgttaaaaacagaagaaaggctaggaaagaaatagcttgttttatgcctgtgattataggatttcatcattatgtgggccactgagtgttattttctcaagttcatgcatatgcagagatttaaactaaatttgtgttctactcaccacgttaagaggcacaagttatcaaagttactaccaatacattctattcccgaagaataacataattttcagtacaattatttggtaggaccctgtcctcttcaatatcagggtaccttgaacccacaggtctgttaaaaacctggagctgataaaatgtcctttaggacgcggaaaaaaaaaagggggccgaaaaaatggcggaaagaatcacgcggtccaacgcccctggcgccctccgcagccccggaatgatg

SEQ ID NO: 392407 - DNA, 327 bp, Homo sapiens
ttttgccaagggtgacatattctaaaaagtggaaataaagtatagaaaaaatagcaaagcactgtttcagatgaccatgttatatttataacatttaaacctagcaaaaatatcaaatgaaacagttttcaaagcaagtcatgaaaattcaacttaaaagaatgtaaaaccggccaggtgtggtgatgcatgcctgtaatcccagcaatttgggaggccaagatgagcagatcacttgaggccaggagttcctgggcaacatggtgagaccgcgcccccgccccatctcttcacttttcttttttttttttttttttcagacagaat

SEQ ID NO: 392408 - DNA, 305 bp, Homo sapiens
agtccctgcgaaaggagtccgctaagattgtttattcattcatttacccagctatccattcattgcttctttaattcaagtatttatggggccctaagtttctgtcaggcccagagaacaagacaggcaaaggctctgccctgcccccccggaacctgtatcctggtgagatgagcaaataaatgaaacggatgatgatggagaggagtcggtgcccctaaggaaactcagcagagtgtagtgtaggcatagagggggacagggggaaagcagcactttagatgggacagccaggcctgcagtct

SEQ ID NO: 392409 - DNA, 455 bp, Homo sapiens
gtgggcctggcactgatttggccctttctcctaagcccccaggtcttcatggacctcctagtgggccagccctggctgggtaggatttcaagcagactgctacccagagcccacagtgagaattggcctggggctgctggagggggctcagatagggcatgagtagggtctgtgaccaggctgacaatgacacagagggaaataacaaagacccaggtaggccccaggcacagcccagctgcaggggcagcctcggcccagccactggcaggagtggatggccatacggctccccgtgacccacctggggccaggggcctgtcagcactcccagagaaggccctgcgggtgtcaggattgaagcaaagggcaagtcgaagttggagggactggtgggatggccccaagtccctctagaacttgtaacttgttgtcactcccaaaactttctgggg

SEQ ID NO: 392410 - DNA, 303 bp, Homo sapiens
tgctaagtaaaaatgctatataactgcatgctttttataaacagtagtggtcttcctgtgtagtctgctatcactggactgccccatatgtaagtccccccaataaaccctatgtctcgttggctggcttcaggtctcttctttggcctctggacatggtactatccctgctggagtcaatagggatctggcatgacaccatatgacacctatcatagcccacaggacatgaaatttgaaagacatttctactctcgcagctcattgtttttgatggcatgtgccaactaagtactgacatgc

SEQ ID NO: 392411 - DNA, 187 bp, Homo sapiens
ggcagatccaagctctgccttcataaaggtcacttcgaggggatgtcacagttgaggcaaaggaaaacaggccactgttagactacatgtgaacagcagaaaaccaacctgtagcacagaaagacctatataattcagcaatgttcggcaccagcttaatcacaagcccccatgcatggcctgctgg

SEQ ID NO: 392412 - DNA, 296 bp, Homo sapiens
agatgacccactaattaggtgtggacacctggaaagggtatgacactcccagtgccccagccatgacagtgcgcgtactgagtctttatggtctcttgtgagtcatacccagcttgcctgtggatggtaccaaactgaggcctgtcctgagcactgagcccaggggctgctggcaagcagcaggtgatacacacacaactactggggtgcataagaacagggtcgccagagtgtttcctcactggtaacaattctgactgtccccgcttttaatgagagaaaaacagcttccagat

SEQ ID NO: 392413 - DNA, 304 bp, Homo sapiens
aagggtatacatgggctcagtaaggtggatccaatccagccactgctgagtgctcaatctgccagcagcagaggccagccctgaatctctgatgtagcctcactacctgagagaatcctctagtcacctggaggcatcatggaaggggcagtggtttgttcccactggaaaagacacttactctgcatgtaaatgtgccttccctgcctacaacgcttctgccaaaatcagtgcttgtagactcagagacggcctcattaattatcaaagtgtcacacacagccttgtttccaaaccaggagat

SEQ ID NO: 392414 - DNA, 696 bp, Homo sapiens
agccatcggaaacctgagtcttctctgtgggaaagtttttaattaaaaatatcaatttcttaaacaggtatgtaggatgactacgatttttttttagatttgacaaattgcatttttctgagaattcatttgtctaagttattgttatttgaatttactgtataaattgttcatattattcccttattgtgcttttaatatctgtgacatctctaatcatttttcctttaatttctgattctgacaatttgttaattatctcttttccttgattagcccatataggagtccttcaattttatgaatatatttttaaaattcaacttttggtttgttgattttctctatagttcttctgctttctattttaattatttctgctctttccatccctgctactataattttcatttgcttttcctccctgcactggctgaacattagttgtaacattgaggaggtgaggtgatagtggtaagctttgttttgtttctaatatgagtaagggaggttttaataactaactattaaaaatgccagttggtatagattttttaaaaatagatatccagtatcatcttaaagagactctttcagttcttaattttctaaaagtttctagatgtcattaataaatgcaaaattttattaagtttttctgcatcttatttagaaaatcatatattatttttcttt

SEQ ID NO: 392415 - DNA, 371 bp, Homo sapiens
gtggtcaatttttgttcctgtctcagaaattgttccccgatgtgacacatgatagtgactttaatgaaattgttaatttggatttctgtagaagctgaccaaataaaaccccgtgtaaacacctgtattagttcattttcacactgctgatagacatacccaaaactggaaacaaaaagaggtttaagtggttttgaaggaagtctgggggtgagtgccgatcttctgagtgtgacgtttcttgcaggagcgcccccttcatttctgcaaatgctgaggtgtttagagatgtatcatcgtggtgcacgatgcatcatcatggtttagcatgtggacttacagttccacacggctggggaggcctcagaatc

SEQ ID NO: 392416 - DNA, 119 bp, Homo sapiens
agtatgtgcagtgttaagctcctgctgtgtgccctcggggcttgaggatactaactctctttgtctcccccagaacactccgagtctgcactggaccgttctcagagcgctgtcctgac

SEQ ID NO: 392417 - DNA, 557 bp, Homo sapiens
ccaccactggtgtcagggtgccagcatgacactgaatccagagctaggaaaagatgcacccatcagctctttacaggaatggtcccaccccctaggggccacaaaactgaagtgacagctccttggggacagagccaggagaggattctggatccaggggccttccccaccacactgcactgcttcctagttagtcactgccctcttgcttagcagaaatcatgaccaagtagctcagggatggccctggtcaaaggcagggccagaatgaaatcaggaagctgaacaagaaacaaaagcacagtcggtctttccttcctcttcactttgcaacagaggcctcaagagtgtgggtgaccaggtagaaggagagagccttactgcccacgcttgtgttctccgaggggaaagtggaaaaggcaagagaatgattctgggaagtggacatagagtattggcaaaactcagaggccacagagacagcattcttgccagctggcctgagccgattccacccagggccttggaggtgcggtggcagtgctgtaatgggcgtg

SEQ ID NO: 392418 - DNA, 407 bp, Homo sapiens
tcttcctgtgtggtaacctgggattcaatctgtgagatgggggtctattaacaggaacccctctcgctttgctgagttttttcttttttaccaaataaattctgctccttactcttcaaagtgtctgcgagcctaatcttttctggtcatgtgacaagagcctggtttttctacaacaatggtagggaaggaaactgaggaggatacttaaatgattaatgaaaattagaaggcacaattcccttccaaaaaatgaaaggatgggtaatatagtaggggttttttgtatagtcattcagaaaataggagtggaactaagaatatataaaaagattgttaagacgtcttaagagcccaggtaaatttagagggcatgagtttgtgagtttgtagtagtaccaatctat

SEQ ID NO: 392419 - DNA, 495 bp, Homo sapiens
caggtggatcacctgaggtcaggagttcgagaccagcctggctaacatggtgaaaccccatctctactaaaaatacaaaaattagccaagcgtgatgcaggtgcctgtactcccagctacttgggaggctgaggcaggagaatcgcttgaacccaggaggcagaagttgcagcgaggcaagatcgcgccactgcactccagcctgggtgacagagcgagactctgtctcaaaaaaaaagaaaaaacatctcataaccttttaggctggtggccagtcaacttcttgctaacggaaatgaaaactcttttgatgttgatggaaaataatcatctttattcatttattcattctgcaagtatttcctgaggacctgctgtgtgctgggcccctgtggactcgcagacagtgagcatccgctctcctgagcttctctcacctctttctgctctggaatttcttctcaatgagaccacactatttctatactctctggt

SEQ ID NO: 392420 - DNA, 200 bp, Homo sapiens
tagatgctatttttctttaggtttccttagatattcttctttgtccactcactccccatttagcataaatcaaattgtgggatactcttgagcggaaacaaacttgtgagcaatagaaggcagctctcttctgtaggctgattatctactaaccagcaagttgccactcctcatcacagatgacaggaggaaaatctctt

SEQ ID NO: 392421 - DNA, 349 bp, Homo sapiens
cagatctgatgagagaatgcctgtgaaggactgggcacggttctggcacatagtggtcaaggccccacaagaagctggtggtggagcagggctgactccaacccagggctccatctttcctcccataatcttcttccttgtcctcatcctgcattgctgccataggtggggcttgaggagcaggacatgtttgcagaagccccattctctgtgtccactgcctggcctgtacccctccctaccccagacagcttggtcctggtgcatctggacagttgctgctgggacatgcgtcagagctgtgagccaagttatctttttttttaaaaataatgtttgtttatttttt

SEQ ID NO: 392422 - DNA, 396 bp, Homo sapiens
aagtgagtttgggaataagaagtatggatcaaacaaagttggtgtgggggtggtggccacaggggccacggggaggtcagctcagtgggaagaattctgccttctctccaagggagaggagggccgaccattacctcaatggcaccccatggccctaacatcattgtctgatgcttgttggtataccaagctggacgtggctgagtgggatgtgaggtgggaagcactgcggggctcccctggtggacacgtggctgcaatcagggccttctggtggcaacatcaaggacatatttcaaacaggcctcggggaggacactgcacatctcattggacggtgcgggagaacacctaggagcagtgaagactgagaaactggtctccccaaggtctacg

SEQ ID NO: 392423 - DNA, 214 bp, Homo sapiens
ctgatgacattgctgtcattcatttcatttatctgtatgctataattgctcattacattgttactactgttattttaaacagttatcttttggatcaattaagaaaaattaaaaatttcattttacctctattcattcctcctctaaagtgcttcctttctttatgcagacccaagttgctgacctaaatcattttcctttcccctgaggaact

SEQ ID NO: 392424 - DNA, 260 bp, Homo sapiens
tgcttcacttggttgtggctccacttggtcgtgctcacacttggctgcagcccggccaccaggctctcgtgcctccacactacacccaagcccctcattgccaccagcctttgccccagctccccctgagcacagcccctcctggcagccatgtgcacagatgcacgtgcagcagcctctgcctgcacacagagacacgggtccaatgcctgtccacgtggagcagcccgttaactacagagccaacaaacaagccagca

SEQ ID NO: 392425 - DNA, 627 bp, Homo sapiens
ggaacaaggagcaagaatgttccatgggagaacagaggacaagaaaaatgaaaaaataagtggcaggggaggaggggagagataacgagattaagacaaagacttttaagcctagacttgggaaatggacaagattatagcaggaacaaatgaagaaagccatttcagctattagaaatcgtagactattcttagataatggacagtacaatggattaattggagaatgatgactatagaaagaagtattaagagataaagctgaaaacagatggagatcacataatagaagattttaatgccatattaattagtcttttttctatgattttatagtgagttgctgcaggtttttgactagggagctacttgataagaatgtaggctttagtaaaagttctcatgtaccagtgtgtaagggagctttcatgaggaaagagattggaagtacagatattaatctatgagaaattgcagtacacctaaaagataattagggcatgaactaaagtaatgtcaatagaatagaaaaagtatacgaaaccctttcttatagtgaaggaactcagaatctgtttgaacatggagtatagaagggaaaatgtaaggtttcactttgacatagaa

SEQ ID NO: 392426 - DNA, 236 bp, Homo sapiens
acaaccagggagagagttactacaccagggagtcgtcagctcaacacctggggatagagaggcctcaggccaggagggaaccctccccatgtccctctccctctccttcctggcctttctcctcctccaacccagagggaggcattttccaacctagggggtgagtcccggcagcccatccccttccccccgtgcagggaggcatctgggcccttccggcccacccctccctctgg

SEQ ID NO: 392427 - DNA, 1153 bp, Homo sapiens
tgacaagaggacacattctcacctccacagaagcccgagtgtcactttggggacagaaatgaccctgccctggtcaccagaatcagagtcccgaggaagcccaggaggacctgggaagtgtttttcaatcagactcagggcaggcgtctccgtgggaatctctgattggaacaggctttgggattcagattgggaccaagagggaggctcacccagggccagggtccttagaatcctgacagttttcacagtaaccccatcgtcctttaaaactgaacatctaactcagaactgacccatttggtcctttctctgtaatccattttccttttctctaggcttcattcttacacttcccttttcaccttcattctgaaaatggagggtgtgcttcctgtggtctaaaccacaggcctcagatgcattacctggaactcaggtgtggctctggctatggctcctgtggacctggcaggctgagggatctttctcattccctggtgcctgcatgcccctgctgtcttctatgcgtggatgcatttgggaaatgcaagtggacactcatagtcgtttcctcaaatgggatactgttgtagagctgatcttgtgcttctcaccctgtcacagagcccccactctcacttgtggatttttgggagagctgaggatggacactttattgggctgtgagctctgcatgatggcaatcgtgaggtctgggtgggcacagccagagccaatggagctggccaaaaggaaagacaggacggaattcctgggaagtcctacagctgctgtctaccatagagttccattgtcttctcctctgctaggattaaaccagaccgaccaagttcatctaggacaatcttcctgacctagagaagtgatgacaggctttaataacacctgtattatacatcagagcaacacctagattagtgtttgattgaataattgagactatgtcctagtcaaggtgacacacaaaatcaattattaccatgattaatattttatattgattaatattttaatactaatattaatcaatgcaatattgatttaatattaattaatattttatatttgacaatagaatcagactcatgttataaataattttgcaaatatatgtatattattattggtc

SEQ ID NO: 392428 - DNA, 273 bp, Homo sapiens
attttacttccttatatctctgagtcacctttaaaaaatacatatatggaaagagcttgtattgcttttacagtcagaaagagcaataaggttattgtcctttctgaaggttatatgagataatagaggggaagtttctgacacgtgattgaggctcaatgaatgtttattttcttcccagaggaaaagcgagttgtcattggatacatctgggtaaagggattatgagtgactttttatttttccaaaataacagtgatttataatcaggaa

SEQ ID NO: 392429 - DNA, 783 bp, Homo sapiens
tccactcatatgaaatgcccagaacaggcaaatccatagaaaaataaagtacttcagtggctgccaggggctggtttggtataggggagaatggagtaggactgcgagtggatatgaggtctcttttgggacgatgaaaatgttctgaaattagatagtggtcctagttccacaactctgtaaatacactataagccaatgaactgttcaatgaaaaagggtgaattttatagtatgtggatttaattttatgatatgcgaattacatctcaataatatatgaagcgtgaaactttattcaataaatatattaaacatttaaaatataattcaattaaaattaaaaatgaagtatagggaaggagaacaagacaacgaggaaagatggaagagaaaatacttggctcaagaaagaaaatgagctgggtgcagtggctgacatctgtaatcccagcacattgtaaggccaaggagttcaagaccagcctgggaaacatagtgagacccatttgttaaaaaagttcagatgtggtggctcacacctgtaattccaacactttgggaggccaaggtgggtggatcgcttgaggtcaggagttcgagaccagtctggccaatgtggtgaaaccccgtctctactacaaatacaaaaattagctgggcatggtgctggaagcctgtaatcccagctacttgggaggctgaggcaggagaattgcttgaacccaagaggtagaagttgcagtgagctgagatcacgcctctgcactccagcctgggtga

SEQ ID NO: 392430 - DNA, 498 bp, Homo sapiens
ctgttttccccttacatgatcctggttctagcatttttttaagagacaaggtcttgctgtcacccaggctgtagtgcagtgacacaatcacagctcacaacagcctcaaactcctgggctcaagcaatcttcccgcttcaacttcccaaatagctgggactacaggtgcatgccaccacacccagctctggttctagccttgactctgccattaactattgtcctgactttgggtatatttctctgtgggtctcagtttccccatgtgccccttagagatgtgtactcatgagggtctttatgcttaggacagttgggattcaagcctccctagttgggtctcatctgaggactgtcatacccgttgctgccactgggggtcagcaccaaaccaaggattgggcgaagaccaggtccatgagggatggtcggagggaaggagggagggaggacacccccgatccccctgccctgctctgtcagtgaagaggtgaggtg

SEQ ID NO: 392431 - DNA, 359 bp, Homo sapiens
aaatagaagcagggagtgccacaccagaagagtggaaacagagatgggctggggagagtcctaggccccattcccctcctcgccatcagccggccctcctctgctctgcctgatccagtgccagctatctcctgatgccccatcttgggtctggctctttctagaccaagggctgaaggctaatccttgtccccatgcccaaaggtaatccattttgcttcttggactgaagtgaacattttagggcccagatgtcctgcctctcgtcacttccaggctgaccctggagcctcagaaccctcaatttccttgttacaggagtaaagacaaccccctcctcccccacaaagctggataaa

SEQ ID NO: 392432 - DNA, 399 bp, Homo sapiens
tcttatccggcttgccgtctgtagagacgaggagttacccccaagaaagggagtccacggaagcgtgagaatggaggaagaacagtgctttgagtgactgctgcagggtcttcctattatttttagttatgaggattctcgttcccagcctgtccttgtcaacatgtgatgaaaccctaaccctttcttcccactgttttttacttgtcctgtgttagggacactctcctaatttttctcatattctttttctctgttgccctccacttttgtgaactctgttagatgggacaaaaaatcccgggactttgcctcctagggctctggtttaacttcagttcgcacagtctgctcttcttaggaccctgtacacagttaaaaggccacatgatccacgga

SEQ ID NO: 392433 - DNA, 420 bp, Homo sapiens
cgaagtgcaagtgcgtggaatcggcaaccttgaaggggcctgtagagaaaggggctcccacaagagaaagggagtccacggaagcgtgagaatggaggaagaacagtgctttgagtgactgctgcagggtcttcctattatttttagttatgaggattctcgttcccagcctgtccttgtcaacatgtgatgaaaccctaaccctttcttcccactgttttttacttgtcctgtgttagggacactctcctaatttttctcatattctttttctctgttgccctccacttttgtgaactctgttagatgggacaaaaaatcccgggactttgcctcctagggctctggtttaacttcagttcgcacagtctgctcttcttaggaccctgtacacagttaaaaggccacatgatccacgga

SEQ ID NO: 392434 - DNA, 416 bp, Homo sapiens
cggagcctgctcttgcccatcggagggacagaggagctctgagggagttttgctcaatgtgcaagtccagatgaagcattttctgtaaagctctcccggtctctcctggctccttcttttcccaccctgaccctgtattaggccctcagggacccgtgggccaagcaacaatgcgggccaccacctcgagatcatgccccaaggcaaccccaaatcctggtcatctactccctggattatccgcctcctggagaaaccagagcccagatctctctccctgagataacccaggctttagaaccaaagagctgagagaccctgtcccttcagagaggcacttgcacctagaggagtctctgggaagcagatggggatatgggacagacgcatcttgaaaaagcccccagatgcctccc

SEQ ID NO: 392435 - DNA, 729 bp, Homo sapiens
gaataccaagtattctgtctggcaattcagggaaacttgagttgggtgatgaggcagcagtctgaaggttagagtgcgaggtctttgagagcactcactcactctgcccagaaacacctgggtctcacccatctctctgctcctgactccctcccccctcctcctacccttccttgcaaaggctgtttccccctctgagggctgttcttggatgaaaggagaggatgccagtcaagtgcttacccccaggggccagcgcatggtaagtacttaagaacgtggcctctgctattaacatattaaatgtgactttttatgtatgtatgtctgtatctatgtatgtatgtatgtgtttgttgtttttagagacagtcttgttctgtcacccaggctagagctgcagtgagccgagattgcaccgctgcgttccagcctgggtgacaggctaaaaaaaaaccctgcctaaaaacaaacaaacaaaaaactttacctcttactaactcatgaccactctgttttcttctatatccaccaccacccaccctctactgtattattttaacgctaaatagttgagtatctgcaagataaggattctttaaagacataatgagaagaccattttaatcatgacaataattaacattaattgcttacatcatctggtatccgcacagtgttaacatctcagatcatctcataaatatctttctagaattggtttgttcc

SEQ ID NO: 392436 - DNA, 579 bp, Homo sapiens
cctgttttgtacaggcactattctgggaactgggaagagagtaatggaaaagcaaacggggtctccacccttgcagagctcgtattttaaaagagcagctagatagtaagcaagtcagttacttagtgcgtcagagataaggggtgtgaagaaaaataaaggaggctgggcatagaggctctcaactgtactcccagcactttgggaggctgaggcaggaggattgcttgagcccaggaggtcaaggctgcagtgagccgagattgcaccgctgcgttccagcctgggtgacaggctaaaaaaaaaccctgcctaaaaacaaacaaacaaaaaactttacctcttactaactcatgaccactctgttttcttctatatccaccaccacccaccctctactgtattattttaacgctaaatagttgagtatctgcaagataaggattctttaaagacataatgagaagaccattttaatcatgacaataattaacattaattgcttacatcatctggtatccgcacagtgttaacatctcagatcatctcataaatatctttctagaattggtttgttcc

SEQ ID NO: 392437 - DNA, 676 bp, Homo sapiens
agttatggtagtaaattttaaattcccctgaagaaaagattgacaaaattgaattatgaagaagagctaagaagattaaattaccagaagaagagcaaagtcttgggagtaacttctcagcagtcttcagacccagaaagttttattaagtagggagtaggaagggtacaataagacaacattgctgaatttgcaaatgtttgggctatctatatgtaaagtccaactggtgtaaacattgcacaggaggatgaacggaatttgtaaaaatttggcattagggagtgttaggaccagcatatcccccatcctagaaccatatggctatcaagtctacttctcttatttctgagatgagcaaactgaatcgtagagaggttagttagcgtcagaccatcacttcagatttcagaatatgaaaatatttataagtcctgcataaacataaactgttattactgcaattcctctcacttaaaaaacaaacaaaacaaacaaacaaaacatttagcatacgatgatgacttttagtatgtctctccatggttaaaggactcttgctcaggatcttaaaataaataaggtagacccaaagaagaaaggcaacccttatacccagggcctcatgtcactcatacattgtatgtcattctggtcatactgataaaactagagt

SEQ ID NO: 392438 - DNA, 302 bp, Homo sapiens
gggttctggcgacagggtgcctcccctaaaggggagctgtgtcttggtagatgctgccctgggggtcaggaataaaggggagctgccttcctgagagcaagaatgatgcagagggtggggtggctcacacctgtaatgtcaacacttagggagaccaaggcaggaggcttatttgaggccctgagttcaagaccaacctgtgcaacaaagtgagaccctgtctctacaaaaaattaaaaaattagccagacatggtggcacgcacctctaggcccagctactcaggaagctgaggcaggagg

SEQ ID NO: 392439 - DNA, 1046 bp, Homo sapiens
  misc_feature (868)..(868): n is a, c, g, or t
  misc_feature (900)..(900): n is a, c, g, or t
atgcaaatattagaacgtgacaaataatggtcagcagaccaggtaagagacaggatttaattttctagctcaaattactggtttttaattataaccttgacatctgtaatcattaatattttgggaagcagtcccttttcatgcttatgttacttggatatatacttgttttaattaaaattgggggccaggcgtggtggctcctgactgtaatcccagcactttgggaggccaaggcaggtgatcacttgaggtcaagagttcgagaccagcctggccaacatagtgaaaccccgtctctgctgaaaatacaaaaattagccaggcatggtggcaggcacctgtaatcccggctacttgggaggctgaggcaggagaatcacttcaatgcagagggtagaggttacagtgagccgagatcttgccactgccctccagcctgggcaacagagcaagaccttgtctcagaaaaacaaaaacaaacaaaagctgtatatatttgcaaaaacactatagtagacataccagaccatcagctccctagggctttttatgaaaaacagcagtccttccccactccccttcccagccccttagaagcagtcattttcaactctccagttccttttggtatatctctctaaataataagcctcttttgctttacagtgtttgttattatttattaacttcactccttaaatagtggtcgtttttggtaggcttacctgaccacctcacatgccaacattaattgtcactctggggccaggcacctggctcacgcctgtaatctcagcactttgggaggccgaggcgggcggatcacaaggtcaggagatcgagaccatcctggctaacacggtgnaaccccatctctactaaaaatacaaaaaattngccgggcgtggtggtgggcgcctgtagtcccagctactctggaggctgaggcaggagaatggtgtgaacccaggaggcggagcttgcggtgggctgagatcgcaccactgcactctagcctgggctacagagcgagactgcgtctc

SEQ ID NO: 392440 - DNA, 603 bp, Homo sapiens
gctccagcattatcttgttctgtttatatctggatcgtgtacttccctaagtcaagaatcagtctctaaagtcactgagaacttttacaaaagtaagtgaatatgaaacaaaagagtatgcacaataatagtggatcagatatgtatcctacttgaggacagtcatttcaggctatcttggaaccaaggaacagacagtacagacatataagcaggttatgaaagtagaagtttatgagcaacctcaaggccctgccctgcagcccaaggaccccatgaagacagctggagaggaaattttagggacaaggtggagcaaaaagaaatctgcaggtggaatcctggatttgggagtaatgactttgactttaaacctttttaaggttctagaatagagtattatgtcatagtaaattcatagtcaatagtaaatacatgattgattgatcatatcttatttaaaactattattgcttccaaaaacttcagaagatagaattaagacaatgaacaggtctagaatctgataatctagaaggatgtgactgggtgcagtggctcatgtctgtaatttgcactttgggaggctgaggcaggtgtatc

SEQ ID NO: 392441 - DNA, 425 bp, Homo sapiens
accacaaaacaagcctctcaagaaggcaggcgccgttcttagtccaatgtgtcgccgggagtgcagctcacgtttctttctcctccgtccagattccccagcttcccttcggcagctgatggcctcaccaacgtgcatttgcagcggtttattcactgaggccctgcggacgttgtcactggaatgcagaggcttggagagacgctgagcacagcttcccgttcagccgctgcatggcctcaagtgcccttctcctctattggattatctgctgattacggggaggtcaggccttggcaggtgcagaatcagtgcctgcaggacacctcaaaggacagtccaagcagacctggtcatgctattaaggacgctggccttagtttctctgtcccaaggatgtatgaaagccaggatctctgtcacag

SEQ ID NO: 392442 - DNA, 199 bp, Homo sapiens
gtctatagcatgcacagctcagagctaagcccaagacgtatgtggctttatatacagattttagggaatcctttcttcaatctttcaggattctccttaactcttcagacttttctcaacttttccttgataatttggctagaaatatggagtttctgtcacagtttctgttgcctacacaactgcttcatgattgggg

SEQ ID NO: 392443 - DNA, 770 bp, Homo sapiens
tcagattatcaattatgaaaataacccaccctgaatttgtgaattctaacggattccatttaacactcttgaagccatgatgccagctaaaagcacctcaggctgagtaaatgaggtgcttttcagagataaaataatcctggaaagcagaacaactaaagataacataaatgaatgaggaggcatttgccctgaatccagaaaatgactttgaaaagaggaaatatttcaccagtgtttatctcacactgtccaagatagactatatttgtcaggcaggaatatcctagccctcagtgggctgcagggtgtgtttaattcttcaagccttacagtctggatatgagacgccacaaggttatccaattctctcctcaccaagcactgtgacacagagaagggggcctgatcagcagatattctatgtctttggatggcatatccctttgtgaaatggaattcctgtggtttgttcatcagtctcttatagattaagttaatataaaagagtgtgtcagagacagatttccttctgaggggggataggaagttgtactgaaagaagtcagggctgagagcaaatcctccacttaaatatagaagcatgaaacacatgggatcaaatcgcattttcttcactaactacttctgtgacactagtcaggttagttcattcctctgaccttgactttcctcagtggataaacagcctacttaggattgttctgaagattctttatggcatttagcatactttctggcaaagtgtg

SEQ ID NO: 392444 - DNA, 334 bp, Homo sapiens
cttgcaagggagtctgggaaggtaagtagttgtggctgggcaattgctcttgtaatagacacagggcagtggggttcatgctgcctgccacagatggagtttgtatttcttttcctcattgtcttgtttgcaacttgactctgccattcaaagctataagtgcccagcagacctgtttccacactgtagatcttgttccactgctctcctggctcttccctattccaggagcatcttggtatcttctctatagctttgtatgacatggtcatggtcatatcttagtgtcattccaaaatacaggatcgtttttgtcagtatgaatggtatctgt

SEQ ID NO: 392445 - DNA, 405 bp, Homo sapiens
gcagctcagaacttagaacctttatatatctcagtcacccatcaatgggggaaaatactgtcagcaggtaaataattgtgaaattttctagctctctttattgcactttaacaatatctggtagatctcttaacttctgtttggtgttccacagattgtcacaccttgaaaattccaccttcttaagtcttgtatccctgatatgcctctgttgtattttcaaccagaaacgtatttctacaacttataaatgggaataattacatgcaccatctttcaaagtcagggctctagtcttggtgcatgaaataagcaaatttggagaaatacacattaaatcaatagctctctgcatgggttttaatggtagtacaagaagagaggctggagagcctccaaacaatc

SEQ ID NO: 392446 - DNA, 358 bp, Homo sapiens
tcgtactgaatgggcaaaagctggcagcattcctcttgaaaacctgcacaagacaagcatgccctctgtcaccactcctattctacatagtattggaagttctggccagggaagtgaggcaagagaaagaaataaagggtatacaaataggaagagaggaagtcaaactatctttccttgaagatgacaataagattagaggaagtcgatctatctttgcttgcagatgacaataggaaaagaggaagtcaaactatctttgcttacaaactacctttggttgcaaaggtttcctttatctacaaaatcccatcccagctatctgagtcctacaacttcttaagttgataagcaaatt

SEQ ID NO: 392447 - DNA, 405 bp, Homo sapiens
ttaagatgctctagactgagaggagggcaggaaggatccccagggatgccccagacactcccttctccaggttggacagatcagttccacctgcgcagctgtgcacttcacattctttcaatgaaaacaacttgccctttttactttaaaaagtgacttagaaaaatgttagaccactaccctaagtagaaaactagctcttttactatatagggaagtgaaccagaaaaataaaagcatagataattaaaaataaaaggtcaaaagcccagtgtggtaggctgaataatggctcccaagaagaacatgccctaatccctgtaacttgggaatgttcccttagatggcaaaagggaccctgcagatatgattaggttaagaacactgagatgaagagattattct

SEQ ID NO: 392448 - DNA, 533 bp, Homo sapiens
attcaggctgcttatttaagtaaaatatttccccattgtgagcagaataattctaaaaagtaccctgatattcaggtatgtatgtgcttcaacaattgtcagaatcattaccataattttttttactccacatccagcaacaggatcctcaaaatgttcctttttttattctaagagcaatgagttctccattgtgtaaattaagatcttaatattcatagttacttgttgctggagtttgtaaattgccagtcttgccttcatgctgagaatcaaattgcatttgtgggctggcaacacccttgttaagccatcctcatggtatgataattagagattcctgctaggtttggcttgtataaaaaagtaacacaggtgggaaaatttacatacacatcttcaataacaaattgttataatttttcagaaggggaatttttgtatttcatgtagattgctcataagcaacagtgtgattgcttttctctcatttttagatatatagcctctgcagtaaggggaccatgttaaga

SEQ ID NO: 392449 - DNA, 476 bp, Homo sapiens
cttcaaggcactactctctctctcacgtgtactgctacaaaggtcctaactggcatgattttattcacatgacaaccacagttacccttttaaagcataaatctagatatcacccttctgctcaaaactctgcactggctttaacccttagaggaaaatataaactcctttccaggagaaacctcataccctaccactctccccttcactcactctaatccagccacactggtcttccttctgttcctttttccatcttaaggacccagcacttactgttccctctacctagggtgctcttacccaagatagtcacatggctggcaccttctcatttaacatcagttcaaacatcaaatcctcagaggtcttcactaaccaactcatctaaattaccacccaaaacactctgtcacagcatcctcttattttctttatagctcttaccattatctgaaataatcttatttacatgt

SEQ ID NO: 392450 - DNA, 583 bp, Homo sapiens
gattggaattactaacagaaacaagacactaggtagtactttatttgaattttctgttgactaacattttattttgatgtcaacaaagcaaatcttgagccaattaaatctgcttaaagctgctttgtctgatgggtaagctctctcagtagttactcttcctcttgtgttaaaggcagaagaatgttctataagccaatttaaatgcaaatttaaattagtagcaacttagttgatttaactcagtacatatttcaaattaagtggtaaatttaaattagtttttaggaggtacctactgtgtattttaaatcagtgattattttggcttttctgatgaaactacatcagaatattacagggtaatgtagtaattggtttgtttttgtttttgttttttgagacggaattttacccttgttgcccatgctggagtgcagtggcgtgatcttggctcactgcaacctccacctcttgggttcaagcgattcttctgtctcagcctcccgagtagctggaactacaggcgcatgccaccatgcccagctcatttttgtatttttagtagagacaggggtttcac

SEQ ID NO: 392451 - DNA, 388 bp, Homo sapiens
cacttccccctgggtacttattagagttcagttgacaaaaccaatagcccttcttacctccaatatcttcacaactggctctcccagcacagccaagccaagagcaaaccctgagcatcagtgatgactcaaatgcagagaggcagggactcggaaaggacagtgctacctgttccatttatgtttcaacccaaagggataagtcaatcaggaggttggagagaggcagagaacataagaaacttcagtattttctttcctttctagattcaaaagcctcaattctcagaacataccagccagagtccaagccacagactgcaaaccaaggtcactgccattgccaagcttgtctcacatgtcctagctattttcttctcacactcat

SEQ ID NO: 392452 - DNA, 155 bp, Homo sapiens
ggacatcccatgtagcactgtgggcctgctgcactccacaacatgaacccacattccacatcagtcgtctcactagctgggtggtccaggctccattctggggagccttgccagctgctcctgcctggctaccgggcagtctgtaaagctttgac

SEQ ID NO: 392453 - DNA, 672 bp, Homo sapiens
acttcgagctcggcacccatcttccctctctcacgtatgatagctgatttccttacattcatgtccacccagaaataactagtttctagaaaagctgtaatatggattgtatttctgtaaagccatatgttccatacgtcctgacatcctcgcagatgccatttgattccattttgtcatattcatttaataaatattgagtgtctgcttggtgcctggcatctgcagtgcaaagaggaataatattcagttctacacgctgaaggatcccatattttgtggcaaagcaagatctaaagacataatttaagtagactgtgaataggttaatttggagctactaactggctatcatgcaggtgggaattgggaggtcacaagaaactttcagcaaatctggcatttgaactgaaccttgaattgtgaactgaatcttcccaggtgaagaaaaggggatgggctttcctgacatgtttcctgatgaaagagcatgtacttgaaagagaatggctggctctgtaaagggtgaaccgtgtgttgtcccaggattaggatgccagcagctgtttactgaaagcacaatatgtgttgtgtgcatggtgctaagtacttgttttatttcacttgatgcacacggcagccatatgaggcagtcctattattattcccatt

SEQ ID NO: 392454 - DNA, 386 bp, Homo sapiens
cgctgggattacaggcatgagccaccgcgcccagcctgcagttgtcctttagtacctgtgtagttatctttaccatgcatggatgcctggcatactttctctactggaatataagggctttttaggcaaaaactgcctctttgtctccactgtaatacccacagtatctagcgtacaattaagcacttatttgaggctcaaaaacattttatggttgctcaccaaagccatcaggtgtacttgaataaggcagagcatgaagctaccctcaggaagggagtggggcaagaatacaacagctaactttcatagggcatttctactttaccaggcactaggcaaaggggttcatgtgcattacttattttaatcctaacaacccatga

SEQ ID NO: 392455 - DNA, 301 bp, Homo sapiens
atcaaagtataaagaaaatgtataaaataaaccagttaagagaatggatgaaggtggaaattttaccatgtgagaaataacacagttttggataatgataaagagtgtattgatggaagaacccacagagaaaactgcagccacgtagaccaaatggaacaaaaagagagtctagaaatacatttatacatttgtagtcaattggcctttgacaaagatgccaagaacacacaatggagaaagctataggatagattttttaatacatgttcatgggaaaactggatatccacaggcaaaa

SEQ ID NO: 392456 - DNA, 258 bp, Homo sapiens
atctcccttttaaatcttgctgcatctcgtaagtccacaagtatatatgtttaatgttcaccattagagcttatgcaaatatttctctggtcattttgattatctgaaatttattccctagtaccttcttcagaaaatgtttatgggaacaacagtcccctgaatttttgaatgtcaatgaaagttttactctggtcgttgtatttaatggtcagtttgaatagatataaaatttttagcttatattttcttccttga

SEQ ID NO: 392457 - DNA, 210 bp, Homo sapiens
acctgcccttcctccacccgtcccagagaatgcactttcccagtgctacatacccacacataaccgcacacacacgcggcacgtgcccttcctccatctgtcctggagaatgcacattcctagtgccgagatgctgccatccctgttctgctacatttgttcttttagaaaagttctggacctttgtgaaggatggtttggagaagaaaa

SEQ ID NO: 392458 - DNA, 730 bp, Homo sapiens
cagttcctttgagtatcatatcagtgctcgtgaagtttcagattttggggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatactgaactgacatgtgtaggtgatatagcccactgacccacatcgttattttaaaaatcagtattcatctgtaactataatagggaagaacatcagaggaaataaacgaatttgtataatactcgaatatgtttccagatgtacatgcttaagcacagctgtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtata

SEQ ID NO: 392459 - DNA, 599 bp, Homo sapiens
tgattgtactcagtatagatttgtttcctggcacacatgtatgcactatgtcacttaatcacagtgcccctattagattacaaactcctgtcaccaagggttttgttccctcttttcaaagcagaacttaaaagaattttgcttacctttaagcgtgcagttcacatcattgactttaactggatggtggttgatggctgatggtcaactaacaaaaaaggagttgaggagttgaggtttcagatataacagaaggatacttaagacttttaaggaataaaaaactaatttttcttagcacaatggttcagatgaaagtaagggtgcatcagagaaggctgtcattggtttatttgttatattcctagctcatggtgattgtatgttagccaaatatcttgcatttgattttaaaacaaatcagaagtagatgactcagaaatgttgacaataaaattatggacaagccccttgctacagcagctcttattaattaaatatctgagacagcagaattaaaagagaagaaagtgatatacaatttggaaggtttggaaagctggccataaaattatttctttcagctggagataccttac

SEQ ID NO: 392460 - DNA, 182 bp, Homo sapiens
ctgccacagcctcccaaagcactgggattacaggcgtgacccaccatgcctggccaagtatcaggttaagatcagctgtgaagggtgggctcagacctcaagctaagaaaacaaaagggctgcagagactgggagagatgtaatgagaatagtggaaaggccttggatctcaggcagccaga

SEQ ID NO: 392461 - DNA, 265 bp, Homo sapiens
cggggacacagcccatcagccagaattccaggctctgattcaactctctcctggagtggaaaccgaatggcagggaagccactaacttcatcctgaacaacgggtaccttccgactaggcatttctcactgatgctgcctggctcagtcaagcccccactcagaacctgtgggcgacactgagtcactttggctgttgatgactgtgatgatatgactactgcctgcatcccagccaggaaagagaagccctgggctactcaaca

SEQ ID NO: 392462 - DNA, 196 bp, Homo sapiens
tctcatgggttttcctaccattactttaatgtggtcagtacaaagcacaccacattttggctaacttagttgatgatgatgtgataagagtgagtgtaaacatttaagaatttcttttcaggttacatgtcaagtgatgtgccaggaaaaatcttgttgttttttgctatatgaacacagcataggactactgtag

SEQ ID NO: 392463 - DNA, 204 bp, Homo sapiens
tgctgggattacaggcatgagccaccgtgcccagccctctgtgctattatatcaaggccaggtgaagatatataaccctcttcaatttaccaaggatggtattatggcttttggtttttaattattgagaaaatatatctataaaagctgacttctgctgggttcagtggcatgggcctgtagtcacagttaagaggctgagca

SEQ ID NO: 392464 - DNA, 214 bp, Homo sapiens
ataagcatgggaccttggctttaaggagttcaaaactgagtaaggaaggtagacaagtgactacaaatgtgagtcagcatcacagctgcttcattagagatatacacattgagagaggtagcagaacacagtggttaaacacactctggccccaggtcgtctgggtgtgattctgcctctgctgctcatcagcagtgagtggcttgggaagtta

SEQ ID NO: 392465 - DNA, 255 bp, Homo sapiens
tgtgtatctttctccccatggtgactctttggcggctctcagcggcccctccctcccttcagatctgtgaacccggctgcagggtgggtgaggttgtcggataaaaggtgtcacctgggctgggcacggtggctcaggcctgtaatctcggcactttgggaggccaaggcgggtggatcacctgaggtcaggagttggagaccagcctggccaacatggcgaaaccctgtctctattaaaaatacaaaaattagc

SEQ ID NO: 392466 - DNA, 281 bp, Homo sapiens
accactgagcaggagatgcctgagagtgaagtgggggctccctgggtcaggaaagctgcccttctcccaccacgtcctcagctctcctggaaggtctgctattcagccttgggttctcatttttctttttcccagctaacccttgaagactttttgtttttttttgtagcattttctttgttgaaggattattctgatctcaaataggcaatatgttctcttttaaaatataaattcttattcagtaagtattgggggtgttagcagatttccttttgaat

SEQ ID NO: 392467 - DNA, 340 bp, Homo sapiens
acacaggataaagaactcttttttccatgtaaaagttcaggtatctaaagtcagctatcatgctgctctgtttaggttttctctttccctgtctaatcaatgctagcttcttctctaagagttctagttcttcttccttggaaccactccagtgcatcaatagcccgcaggaataaattattaacatcataaatagctttgatttggctttgattaaaattaaagattttttttttttttttgagagggagttttttttcgctcttgttggcccaggcgggaatgcaagggcgcaatctcggctcactgtcacctccacctcccaggttcaaacaattct

SEQ ID NO: 392468 - DNA, 297 bp, Homo sapiens
ggtgagtagctctttgactagaacgtaagaaaaagatttctaactaggactcacaatccaaaggcaataccagactggtaaattttactacataaaattaataaaatgggccaggcgcggtggctcacgcctataatcccagcactttgggaggccaaggtgggccgatcatgaggtcaagagattgagaccattctggccaacatggcgaaaccccatctctactaaaaatacaaaaattagctgggcatggtggcgtgcacctgtagtcccagctactcaggaagctgaggcaga

SEQ ID NO: 392469 - DNA, 775 bp, Homo sapiens
aatagcttgaacccgtgggggcagaggttgctgtgagacaagatcacgccacttcactccagcctggacgaaagagtgaactccatctcaaaaaacaaaaaaggaggtctgattcacattcagattcttgtccatccattgcctttgcactagatttatgagaggacaaactttttattagttggagattggtaagtcacctgccctagggaataatgagaaactgggtaattcaactgaatttttctccatcttcttcaaaatcatgtttttgtcttctgttactttttcatcagagtactgccatggcaaaaaaacaaaacacttccccactcaggtcccactcctgagagataaccacatttaagtacttctgacttgtaatagaatgcaaaatcggggcttccaagtgtggtttactattttgtttagaattaatttgtagaatactagacacttttttcagaaccacatatgaaggactttatatcttttgtgattgttcacagattttggtggccggacgttaggagtatagagctgaagagagaattcctgtgctttagaggttcgctgggtagtgagggagagaagcaggctaatggctgggtgcatccagttttagggtggtaattcctgtaacacaagtgtgaacaacatagtcaagaacattcattcattcgtttgttcattcattcagcaaatagttaccgagtggctgctgtgtaccaggcactgaggagggagtgatgagcgaaaacaggcattgtttctc

SEQ ID NO: 392470 - DNA, 888 bp, Homo sapiens
ttccgactgctcccttcgccactcgcgcggcttccactcctggactcggcctccacccctgggcttggcctcaaagcctcctcagttgtcggccctggaaggtgcccagcggcgggagacatccccctttcgaaccacccccccactccaagtggcgagcagcgaccgtaaggccggagggggcgagacgcagcgaaacagaggaagacgcgacaggcgaggagcgcgctgcagtggcgagagagaagcacaaacgcgacagccacgaacggaatcacacccggcgctgatagtgacgaagcagagagaggcaagagagcacgtcgcgggaacagaacggaccagcggaaacgagaagaggacagacggaagagaaaacaacgcgcggacagacggcgacggaaggagagcgcaggccgcgcagccgacgaggcgcacctcactccagcgacaccgcaccgtcctcacctcactcctgcggcagagcgacgaagagtagcatcggcagcggtcttacgagcgaagaactacggccagcgccgcgcaacgacgagaccccagcacacgccaagacgagagcagaggcgagcgtaccgccagagcgagggcaggaccaagggagcaaacgatacacgcaacatctcatccacataaaaccacaaaaatatcaattcacaatgaaccactatatacatgaaaatcaccgatccagtgcttgagcgccccaagatcggacaccacatcacactcgcatctagtacacgaaactcttcacgtccacttcgtgagtaaataaaacaacatacatatgagccaacacaacagctaatcaaactagacacaagacaaaatataaacctcatgacttatatacaacatccataatca

SEQ ID NO: 392471 - DNA, 508 bp, Homo sapiens
tggatgcagtttgtctacacaagagtacatataactatgccaactgttcttaaaatataaatagaaaccaaggtacagagcgtactctgagctggtcttgctatcgcagcataagcccttcagcctgcacatattagtaattaccttggagcagcagttttctattgaaaacacctatcgtttttatctctccagatactgaagagatacccttctgtatctgtgaccctttagctttctggattgctgaattaaatcctatccttcgtgttttctgagacaaagttttgctcctattgcccaggctggagtgaagtgggcagatcacctgaggtcaggagttcaggaccagcctggccaacatggtggaaccctgtctctactaaaaatacaaaaaattagccaggtgtggtgacgggcacctgtaaacccagctactcgggaggctgaggcaggagaattgcttgaacccaggaggcagaggttacagtgagccgagattgtgcca

SEQ ID NO: 392472 - DNA, 294 bp, Homo sapiens
gtagagtggaggggtggtctagggggcctccctggttaggctggagtcagtgttgggccacactccatggactcaaagtttttgaataaagaccattatcatgttaccatcttctgcccaagtcctttttgatgacttttcttttagggcagaaaatgtgctcatgtcaaggcaacatatacctaaacttctaattaagtctataatcccagaagaatttcatttagctaacaagcaactgggagagaacattctggaacaaaacatctgaaactgaaagggcagcccaaagga

SEQ ID NO: 392473 - DNA, 881 bp, Homo sapiens
tggatgctttttgccattctgatggtaaatgatgagacaggctaccatggatttcagcaccccttctgtgtttgatcagcaaagaggtgactcatctgaggaagttgacctgaccatggtttatcaagcagcctctaatggagatgtcaatgctctgactgcagtgattcgggaagacccttctatcctagaatgctgtgacagtgaaggatgcacgcccttgatgcatgcggtttctggacgtcaagcggacacagtgaagctgctgttgaagatgggagccaatattaacatgcaggatgcttatggccgcacaagtttatgcctggccacctacctgggctggcttgaaggctgtgtgagtctactcagaaacggtgccaagcacaatatcccagataaaaatggccgcctgccactgcatgctgccactgctgagcccgatatgaggctcctcacggtcctgttgcaacagtcgaacatcagcgagattaatcaccaggacaatgagtgagttcaggtgatctgccaccctggcctcccaaagtgctgagattacaggacctcagaagaatcattgacatagagtgaggcttgtctgttgcagctaccgggagttaaatggaaactaacctctcctgctctcattttagccttgacaggaagagtgttctatcaagagaggctctgagctgttggcatctgggttagaactttgaatgcatttaaccagagaagcactgttatgcacagcatttaggatatatatattgtttaggatatattaaatgcacattcttatgtaagcagatttttgtgagcagtctgacaaacaaaacttcaattgtagaaccactctgagaaaataaatttaagttgca

SEQ ID NO: 392474 - DNA, 286 bp, Homo sapiens
ctcagcatctactacttcctcccacctaccaccaaatattgcacaagcaatcaatggaaaagtgcctttttccagtaatagagccttaatcttatctcacagatgaacttctagtttttagttaaggctagacatggactaggacttgaaggagatgtaggtaacagcttagagagaaagcatagaagaatggagtataaatcctcagagaggccaggcacggtggctcacacctatgatcccagcactttgggaggctgaggtaggcagatcacgaggtcagggg

SEQ ID NO: 392475 - DNA, 499 bp, Homo sapiens
ggcccccagctcaacagacttttatcacatctcaggatctggataatctctttgcctgtaggaattttttttaattaagatttttatcattgtcatccccttcccccttccagttcatttaagactgttatgaaacaaaactcattatgcttcaaaatctgacagagctaaggccccggagaaagtgagaggaggcggtagcagggggtgcttccttccatttccccccctccgtggttttctcctgtggttggttcacttaggacggcccggagcctactgggttgaggtgagtagggcttcccagacctcgcagggtccatccacgggaaagtctgttgtcagccagagaagagaatgctaccttcccagggcagggggtttctccagacaccagtgctcaggatggaagaaaaaaggaagcagactggagaggaaaggagagagaagtgaggtgcattttgcatggctcagctggaggaatactgtcactagagaa

SEQ ID NO: 392476 - DNA, 428 bp, Homo sapiens
ttattcacactatagaaaacagaaatctgagctgaatcacagaaaagtgacataactggccaagatcacatagccagtaagtggcagagctggggctaaagggattatattggccagactccttcattgacacaaaattttgggaagcaatttgtttgtacaatcttttttggaatggaaagatactaatatacctctaactttggagcattctcattaaaagagaaaagagtggcacggttcatctggcctgccaaatgaggattacatagcccatattccagtatctggaggatctgttgtaaaatgtggagtaaataatttcagctattggggtgcttcatttaggtattatctttatcttacaaacttccaaaaaaacacttcagctaacgttgacatatatataatatttctcactaaagcta

SEQ ID NO: 392477 - DNA, 357 bp, Homo sapiens
tgtaactttgcacaagcagttcatctccatagtacaattaaacaataagttcaaacagtaacaaaacaataagaggcctggcggtggctcatgcctgtaatcccagcactttgggaggccgaggcgggtggatcacaaggtcaggaaatcgagaccgtccttgctaacatggtgaaaccccgtctgtattaaaaatacaaaaaattagccgggtgtggtggtgggcgtctataatcccagctacttgggaggctgaggcaggagaatggcatgaacctgggaggcggagcttgcagtgagccaagatcatgccactgcactccatcctgggtgacagagctagatagactccctctc

SEQ ID NO: 392478 - DNA, 406 bp, Homo sapiens
ttagacatatgctttttggttgtgaatactataaaatttgatttcttctcctatggagaattataagttatatcataatgagaatccacttgttcccctagagttctacgctgaatctgtagaaccaaataaaggaatggatttaggttttaggagcctgaatgaaataaaaaccatttctgaatctggccaattctggtaagttcacaactattagaggttatcagtgctagaatttccaatagataataatcattctttattcattcctgagaatttgattttacaaggacgtttctgtatttcattctctggagactgtattttcatgtttagatgtgtttggacaaggatttaagtaagaacagttgtagttttaggggattgtggtgactcccaggattga

SEQ ID NO: 392479 - DNA, 351 bp, Homo sapiens
caggccttttccttggcaggtactgggagaagcagagataacgttgcggcaatggtgtggaagaaaaattgggaaaattgagctgttggacaaggccaggattgggagaggcagccttcgggtgccagccttgctggctgtgacggctgacccacccaagtgcagtgggcgtgggcgataagagaactgccacagcctgcccagtcacagtgctggtgccaggacatcaaatgccacccagcccccacagcttccggacactggccaagtccccaagggctgcagcggcccaaggcctcacccgtacagccagccactggcctctgccttcccagaagtctgtgcctgggg

SEQ ID NO: 392480 - DNA, 470 bp, Homo sapiens
aatgtacagatttttaaatcaatgaactgtacattttaaaagggtgaattggccaggagcagtggcttacgcctttaatcccagcactttgggaggccgaggcaggcagatcacaaggtcaggagtttgagaccagcctggccaacacagtgaaaccccgtctctactaaaaatacaaaaaaaaaaaaattagccggtgtggtggtgggtgcctgtaatctcagctacttgggaggctgaagcaggagaatcgcttgaacctggaaggcggaggttgcagtgagctgagatcgtgctactgcactacagcctgggcaacaatccatctcaaaaacaaacaaacaaacaaaaaaaacaggtgaattttatgatatgagaattatatttcaataaagtttttaaaactactatagaaaaataatttaaatttttattaaaatatataggttaaaatatatgcatttcttaac

SEQ ID NO: 392481 - DNA, 400 bp, Homo sapiens
aaaccaccatgatgttctgagatgtggctggtcgggtaaagtgggtgggagaggccgggcaggtgagtggctttgaaggtgaagaggctacaggtgattacctccagtgggccaacctgtggagggctcggcatctttgcctaagaggaagtcacaccccttccacaccctccaaccccacaactgaggttagccaacagctctttaaaaataaagccaggccggatgcagcggctcccgtttgtaatcccaacactttgggaggccaaagcagctggaccacctgaggtcaggagtttatgagaccagcctgaccaacatggagaaactctgtctctactaaaaatacaaaattatccaggcatcgtggcgcacacctgtaatcccagctactcgggag

SEQ ID NO: 392482 - DNA, 422 bp, Homo sapiens
ttaccacgattacgctcctagacgggtagttgggggattgcaagaagaaaaaaatacttgatagtgtccaggataattttcaggttcaaggatatatgatgttagaggcagctggcattaaacaacagatctgaagaggagactaggcattaagaagcatttctgtgggaaccatgaaatctccagatttgggggatatactctaccaaattagacatggacctcagatcctggccagaagctcattctgtaatgggagctcctgttatatttatcgtatttacccagcatgagatcaagggaatggaatactgcatgtgataggctgctgtgggcaaactgaggaatattgagagagacttgaaggtgtggagggaacaaagtaaaagacagtgagaattgggaggtgaaacgagatactt

SEQ ID NO: 392483 - DNA, 154 bp, Homo sapiens
aaggagatggaggagtctctttcacacatatgcacatacacagtatgctggaggaagctctatcatcttttatgaatctatcttaagaaattatgttgttacttccaccacatggattcatttgaaacaagtcatcaaagttgtcccatcttca

SEQ ID NO: 392484 - DNA, 801 bp, Homo sapiens
cagatgaagatgtctacccagtgtgtctcagggatttgcccaggaagaaacagggagacagcaattgcatgaggtcctgcacaggccatcctgaccacaatactctgcctttccacgataccctccctccattccccaggaaggcggccagagagagctagtgctggtttaagacgggcttcggtgatatgaaggctaatgttctgtcggctcacacctgtgtgctttctgttgctttcagccaatctttgtggattattcattgcctgtaccatcatggttgctaaacagtttggatattagtcttggatcttttgcctaactttaaagttgacagtcaaaacatgatggaaattagttgagaattaagatgacacatatactgtgatttgtttgtcaggattgagagaaagagtaggatgttgttaggataatgatgcatggtatgtaagggaggtgtcacagagtttgatgtagaaaatcatgcgtcatatctgtatttttacctgttctgcaaaaatcaattttatattgttgttataaataaatgtacattgtatttttttaaccctcttcaggattaaccctcccattagttgtctatattctttgcctgctgtaaaataggagatatgcattttcctttcatccccgtgcaagctggctaggaaatgaatccccacggtagaaactcatcgccctacaagttaatagaaaaatgctgttattgctggtgtaaattaggttgcatacttaattggttacagtatttttgcaggcaattttacatcataaatgcca

SEQ ID NO: 392485 - DNA, 801 bp, Homo sapiens
tctctaatgctgaatggtacttgattatatatgcctctgaaatggcaacttgtagagatatttatgatgtatctttaccttgtttaattttagaaggttttttaaatttaattttatttttttgagatggagtttcatcctttcacctaggctggagagaagtggcaggatctcagatcactgcaacctcttcctcctgggttcaagcagttctcctgcttcagcctcccaagcagttgggattatacgtgtccactaccatgcctggctaattttgtgtgattttggcgaaagagggaaatccattcttcataaaaataaaattaaaaaaattaagaattaacaagagaaaaaggaaagaagagatttcccttgggaagggcccggggtggcacaagagaacagaggaggaagagcataaggatccggggaaatccctaacgtgaggaggaaaaaacccggcgagtcaagggaagagtgggtggtgggggaaattcagtgaatagaatggtggtcgaaagtgctgggtaccctggagcgggcaaacaaagaattcgaagatggagcattttagaaaattcaacaaaggcgaactcaaatcagaatgggttcgggagacacggcctcggtctggctcccagcgtggggaagaaagaagcaaggatctcttggctccaaagagacaaaggacacaaaaaagaggaggtgctacaagaaagaggccccccaagagggaaggggggacggggaatattagcgccggaaaggggatggcaaagaattagagaggcgccacccggg

SEQ ID NO: 392486 - DNA, 351 bp, Homo sapiens
atccatgtctagggttttaagttcatgaaactagtggaaaaaagaaaagctatcaaagacagggaagtatatcaccataaaacccaaatatatgaaaaagaaatatctgttctttgtatatgatgacagtatttgacaatacaggaaagtcttgcttggtaagaccatttctcctaacttttggaagacaccagataagaaatttgtcagaggcacagtcctgactgaaggagacttttccatataacccccatgctatgttttttccttcccaacccatctcacttatccttataaaacaatataatatgggttaatatatcagatactccaaaacagacaaagagaaca

SEQ ID NO: 392487 - DNA, 1544 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaa

SEQ ID NO: 392488 - DNA, 4049 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcattgttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaaaaaaaaatt

SEQ ID NO: 392489 - DNA, 3912 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaaaggaaaaaccatgttacatacagcatattccaaagaaatgaactcttctgcaatttaaattataagtaatatgttattttggatcctagagaaaccattttctctacatttcatgagcattgttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaaaaaaaaatt

SEQ ID NO: 392490 - DNA, 2996 bp, Homo sapiens
ttatctccagaattcggcttagcgtggtcccggccgaggtacccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcattgttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaaaaaaaaatt

SEQ ID NO: 392491 - DNA, 1585 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaagaaaaaaaaaagaagaaaaacaaacagacaaaaaagggggg

SEQ ID NO: 392492 - DNA, 3924 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcattgttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattctta

SEQ ID NO: 392493 - DNA, 4124 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacagttacataagagcaaaacatgtgtgtgcctagtcactatcacaccctgtcaaaagcagagagcagctggagctgaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcattgttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaaaaaaaaatt

SEQ ID NO: 392494 - DNA, 3800 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatcttcagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaatactataacatgactgtgaaaatggcaatgttattgtcttcctataattatgaatatttttggatggattattagaatacatgaactcactaatgaaaggcatttgtaataagtcagaaagggacataggattcacatatcagactgttagggggagagtaatttatcagttctttggtctttctatttgtcattcatactatgtgatgaagatgtaagtgcaagggcatttataacactatactgcattcattaagataataggatcatgatttttcattaactcatttgattgatattatctccatgcattttttatttcttttagaaatgtaattatttgctctagcaatcattgctaacctctagtttgtagaaaatcaacactttataaatacataattatgatattatttttcattgtatcactgttctaaaaataccatatgattatagctgccactccatcaggagcaaattcttctgttaaaagctaactgatcaaccttgaccacttttttgacatgtgagatcaaagtgtcaagttggctgaggttttttggaaagctttagaactaataagctgctggtggcagctttgtaacgtatgattatctaagctgattttgatgctaaattatcttagtgatctaaggggcagtttagtgaagatggaatcttgtatttaaaatagccttttaaaatttgttttgtggtgatgtattttgacaacttccatctttaggagttatataatcaccttgattttagtttcctgatgtttggactatttataatcaaggacaccaagcaagcataagcatatctatatttctgactggtgtctctttgagaaggatgggaagtagaaaaaaaaaaaagaaagaaaggaaaggaagagaggagagaagaaggcagggatctccactatgtatgttttcactttagaactgttgagcccatgcttaattttaatctagaagtctttaaatggtgagacagtgactggagcatgccaatcagagagcatttgtcttcagaaaaaaaaaaaatctgagtttgagactagcctggccaacatgttgaaaccccatatctactaaaaatacaaaaattagcctggtgtggtggcgcacgcctgtagtcccagctactctggagcctgaggaacgtgaatcgcttgaacccagaagacagaggttgcagtgagctgagatggcactattgcactccagcctgggtgacacagcaagactctgtctcaaaaaaaaaaaaaaaaaaaaaaggaaaaaaaagaaagaaagaaagtcccagcacacctagataatttaccgagctcttcagcaaaaaccatgttacatacagcatattccaaagaaatgaactcttctgcaatttaaattataagtaatatgttattttggatcctagagaaaccattttctctacatttcatgagcattgttagaaaagagtttacaagaattaggaagagggaacaattttaatggtcagaaaagaataaaatttattctagttcaagaagtgcacacaaagaatatgcattaatctaacaactatgagattaaatctttcaaaaaggtcaaaggaggattgagaagtttacagagatgtccacggcattttatatcaatctcaaaggtaaggtctgcatttttataaaccaacttaaacttctgttgagataggatattttgttttcaagccaaaattaccattaatcaaatatgttttaattatctgatttagatgatctactttttatgcctggcttactgtaagttttttattctgatacacagttcaaacatcattgcaacaaagaagtgcctgtatttagatcaaaggcaagactttctatgtgtttgttttgcataataatatgaatataatttaagtctatcaatagtcaaaacataaacaaaagctaattaactggcactgttgtcacctgagactaagtggatgttgttggctgacatacaggctcagccagcagagaaagaattctgaattccccttgctgaactgaactattctgttacatatggttgacaaatctgtgtgttatttcttttctacctaccatatttaaatttatgagtatcaaccgaggacatagtcaaaccttcgatgatgaacattcctgattttttgcctgattattctctgttgagctctacttgtggtcattcaagattttatgatgttgaaaggaaaagtgaatatgacctttaaaaattgtattttgggtgatgatagtctcaccactataaaactgtcaattattgcctaatgttaaagatatccatcattgtgattaattaaacctataatgagtattcttaatggagaattcttaatggatggattatcccctgatcttttctttaaaatttctctgcacacacaggacttctcattttccaataaatgggtgtactctgccccaatttctagggaaaaaaaaatt

SEQ ID NO: 392495 - DNA, 909 bp, Homo sapiens
agggagtgtgtgtatttcctcccgttctttatcagagcccccaaaataagtaggaatgggcagtggctattcacattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagaaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtaagtttccagaca

SEQ ID NO: 392496 - DNA, 523 bp, Homo sapiens
ccaccaacattgcacttatgtttttgtttaaaaaaaaaaaagtctatggctgcctgcacctgagtacagtgtgaaatcaagaaacggcacagtttttagaaacatctgcttactgattgagcttcattaactcctcatgtgagatcccagtcctgaaccacaggtgctgttgcttacagtgcgtaagaaaaataaatgagttcagcttccaggttagtgctgtgaggttacataaactaatcattaaacatgacagctaagatattttagctactgtttaactttaaaagatttgttaataaataatgctattgcacactggaggccttgaccctgtctctacctgagtcacaaacctttgtgtttgtatagaagttacactatttcctacatttgacttgaaatttagtcacattttcttctcattgtcaattatctactttctctctcattcattcagtcatcaataaacattgaaaatgatgaatgcaacttgagaccaaaagagttgggaaaaatcctt

SEQ ID NO: 392497 - DNA, 223 bp, Homo sapiens
caagactgatgtgtccaacagcagaaaaagctagtccagaagtttaagcacatggtccacttgactaaccaccacgtgggaccctcagggcccctggtccccaggcaatggcagggacaccaaggccaggtctaccctcaaatccttcccaatggcacgacagaccgctgggggaccaagacctacaatctaagaaaatcagattggagctggctagcctggt

SEQ ID NO: 392498 - DNA, 594 bp, Homo sapiens
ggaattggggctaggaaatgccggctgtgtggtgggattgaacaaagccgtggggtgtggttaagggacacgttgtaatcatatctgagtccaaatcaggctcttttactggtagccctgcgagcttggggatagtattcccgtgcctcagttccttcctttgtaaaattggggtaaaattacagccagtcacaggagtcagtgagacggtgcagggaaagggtttcccaggccctggcccgtaaacttcagtgcgttcgactttgaatcatgcgccacaagacagttgtttcttttaaatctgaaggacttctgtccagattccctgtgcacaatgtttttctgtttttattttgttgatgaaaatgtgtcttttcctaccattgctgtacaaattgcatatttcatgttttcatggctgacttcatggggattcgacagttcagtctcatgtcctgcaatttttaagatggtctttttctcctagaaattggagggtccacgtccccacgtccccacggcccccaagccgatggtccgcatttgcctggcaggagggcagaggggagagctgcatgtctgtggaaggagagt

SEQ ID NO: 392499 - DNA, 627 bp, Homo sapiens
tggtaccagatgcaggtaggatacagtagggagactcggctctaccttgtctggtatggttggctctgcattgaagctttcacatagtaaatcgtgagtaaacaggatgttatttgcacagagaaaggggtcaacggaagtagaactttgttagggatattaccataacagatcgcaaagtgagcttcctgaagtcttaagatcataaagcacactcacgtgtaaagaataaagtggaaattctcatttaatcaaaaaccctcctttggcacatctactcctgtgtagtgcacagattagggccctcaacatcatttaggagcttgttagaaaggcagaatctcagatcctaaccctgaactatcaagtaggaatgtatattttcacaagattccaggtaattcataagcacattcaagtttgggaagcactgaacactgcccggccagcacttagtttgatttattgttgataaaaataaccagcaaaacaaaaatgtattacctctgcacaagaagctgggaaaacatttccataatactctccctgtcagattagcttatctcaaacacagttctaatcatgacattcaaaaccttcaatgacttcacctatcaaaaaaaaaaa

SEQ ID NO: 392500 - DNA, 676 bp, Homo sapiens
ttactgaggaaagatcctcgttagtacttagtaccaccgttcatgaattaggacgttttccactttggctgttgataatcgacactattcccagccatgtgtgagtcatgggcactgttttctttattattttcaggtgggtttttccccaagttcgggtagttttgtcacttgcgtgcactgaccagtacttaactgaatacttgacggcgactcttcacatatctccagagttttctctacacgcagctctcttctctccagtattctgcctttttgacttctcttgacctggagctccatctcctcaattcaagagatcaatggtcttttacctaggtttcctctacctgctccaaggcctgaaacttttctccaggcaataagataggatgataggaaggtttacctcatttgtttcccatctttcagggaccgacctttgtccttcattgcctgaaacagtatgtcaagtaacactgtttcatctactttgtctggagtttagttgtttcagctggcagagtatgttcaggtagtagggtaaatctaggatgttattctatctttgtcagaagcagaaatccaaggcattcttaccactttactgtaattctatagtatatttttagtgtaatttagtataattcgataagctaagcaggatcatttgaaa

SEQ ID NO: 392501 - DNA, 439 bp, Homo sapiens
gggagttggtgaaataagagtgggaaaatgttgacacctccgtgagccgggtgacaagctgcttggtggttcactagacagggagttataaattggccgcttttcaacatcgacagataaaaatcaatagccttcccataatgccatcattaatcaattagagtctgtaatgggaaaagcagatgccactcccccacagtttctgggaataaacaaagtgtataaggcctaaaagaagaaagctatagaacttgactgaagcccacatctgtggaaaggcatactatgttcttggagtgggaacatcaacactatagagatggcagttcctctccagttaatctggaagtgcaagtatcgatgagtaaatccaattaaattccaacaagagcctggtctaaaatgtaacaggctgattttacagtatcgctggactccc

SEQ ID NO: 392502 - DNA, 305 bp, Homo sapiens
ttgtggaaatatgaatatagttagtacactagatgatagttgtatagaaatgttaaatttcttgagtgtggtgatttggttgtggttatgtaagagaatgcccttgttctcagcagatatatgctaaagtatttaaaggtaaaatgtcatgatgtcttcaaccaactccatatatatatgcttggagaaagtggccaacgttaaaactggtgaatctaagtgaagcgtctataggcattcatggtactgttcttacaactatcccaaaggcatttttttttttttcagatggagtcttactctgt

SEQ ID NO: 392503 - DNA, 202 bp, Homo sapiens
tctatgcatcatattgctttggcactggtgcgaggatcattttagtggatgtattgcatccacagaattgactgggtgtatgctaaaatatatgtgcaccaaaaatagatttttagcctcatttatcttggtgtgattattacacattgtgtgcctgtatcaaaatatgttgtgtaccccataaatataaacaatctagtag

SEQ ID NO: 392504 - DNA, 426 bp, Homo sapiens
tgcagaagtgaaacatgctttccaagagcagcaacaggcagggtcacccagcacccaggtggatacttgggccgccaaggcttctggaagccaggacaaatggaaagaatattggaacatggaaaggtctgaaaggtggcaatttgtccaaatctacagttgaatcagaagagaagcggtgggtcaggaagagggtgatttgagttctgtttcatcagactcatctctgtttctctttccatctctcaggcggagttagaacattccatttttttatccaaaattatcttttgctcggatttgggaactgacttaatacggagctgggaatggagacaccaaaaacagaaccagacaaagctgagggtttgttctcgcccctcctggacagcgtgagttgctcgctgctttcaggccctgtctgaa

SEQ ID NO: 392505 - DNA, 459 bp, Homo sapiens
tgagatagagtcttgctctgttgcccaggctggagtatagttatgagatctgagctcactacaacctccacctcctgggttcaagcaattcttgggtctcagcctcctgagcaaactgggattaaaggtgcctgccaccatgcccagctaatctttgtattttagtaaagacggggtttcaccacgttggcaaaggcagatcttgaactcctgacctcaaatgattggtctgcctcagcctgccaaagtgctgggattacaggcgtgagctactgcactgcccagcctttttgtctaatttcatcccagccctgatcagattattggctgattctgtgtatggaagtagataccattcctctgaacatgagtatacacagcaatgacaggtgtttggctgtgttaaaacttccaaaccttcaggcgtacgctgcctgaaacactcagtcattcatttcc

SEQ ID NO: 392506 - DNA, 274 bp, Homo sapiens
ggagacaagctacaacggtgtctggccaaacgtcacaatggattattgaatagctgcttcccgtgcactcagaaaggaagtcaatcactaggagcccccaggggctccaaggagaacaagcatgctttcctttttcaggagggccactggcctggaagaccagacagaaggctgcagaggctggtgccgctccacatccactcaggcccaagcctgacaccttggaggacacgctggagacacgtgggtgagtaacccacagctctttggagaa

SEQ ID NO: 392507 - DNA, 700 bp, Homo sapiens
ctccaatttcaataataactgtacatacacacttacactgaaaaagctgtgtaagttgaacaagcatgtcacaaatattgagttttagagatttaccttgatttgatcaaggatcttcgtcacaaatgtgagaggggttcaaagtgacattcacatttttcattcataacttaccagttataactttacatttatttgtgtgattgactaatgttgacctcatcctttagaatatatgaggactttattttatttcgtataccataccactatccagcacatagtcgatgctcaaataatacttaatgaaaaaatgaagtagactcttatcccagacttcctgaatctaaataactaggtattggacccaggcagtatatactgaaaagagaattacactgaaaataaaatagtgagcatcatcctgataaaggcagtaactacattcaagagaacaagagtaggtgggcatggtgcctcatgcctgtaatctcagcacttttggaagccgaggtgggtggatcacttgagttcagagttggagaccagcctggccaacatggtgaaacccgtctctactaaaaatacaaaaattagtcgggcgtggtggtgcacatctgcaatcccagctactcaggaggctgaggcacaagaatttacttgaatctgggaggcagagagttgcagtgagctgagatag

SEQ ID NO: 392508 - DNA, 299 bp, Homo sapiens
actttggctatagttactggcatatgaaactaccagacgcaaatagatcagaagctactagaattggggagaaactgcattgccaaagaaacatgagcctaaaacagtcagtgactgtcaaaacaaccccaggcctccaaacttccacaagcagaaagcaggctgtgggatcttgcagcccctaacccctaagaaagatgtactccctattttagtccattttctgttgcttataacagaataccaaaaactcagtaatttataaggaaaaggaatttacttcttacagttatagaagc

SEQ ID NO: 392509 - DNA, 313 bp, Homo sapiens
aatgttttgtctctggttatcgaagtagtcgtgtggtagaatacctccttggcagggtagtactgaatatagctcataatgctcctgaattgctgatatcacttgttggttggtactcatcttcttttcctcttacttcccttgccttccatcaaatttcttcaagttgcaaattccttcaacttgctgaggatgccccagcaggaatacttgaactggaggctactggtttagggttttagtctgtttcaggctccacccagttactttgagggcagaggggattaatgtctagcaggacacctgggagact

SEQ ID NO: 392510 - DNA, 213 bp, Homo sapiens
cttgagaatgctcccatcagttatggcaaggaccccaggctatgaacagcagtccaaatccaaattggcctctccagggttacctacgtagacagggcttgctttgtgatgtagagagaatccaggggcctgtggactttgaactgagacagtggttgatttccctcataggtcttctaatcactcagccccaagaccctcaagtcacaaaag

SEQ ID NO: 392511 - DNA, 236 bp, Homo sapiens
cattctgatactactgaatgaatgggttgggtgattcaagaaagggagagtaacaggaaggtcaggcaggtagaaagttgatatgatacttaaagcaaggaatgtgaaagcctaccttaaggtagtgttgctggagtggagaagagagaaaggagagatgctaaagtgattaaactgatgatacatggagaaaaaggtggggtcggttgggtagcggggtgaagagaagaaggtag

SEQ ID NO: 392512 - DNA, 404 bp, Homo sapiens
cctcaacactcttgatgaactgggtatattcctataaaagtagtacactacagtgataactttcaagctgggtttgttagtgatcataatggtggctacccatcctcattgattattactgatagaagaaagtaatcaactgtattgaacaatgaaatatagcagatgtaataaatatcgcttgagtgtactctatgataattacaaagttctgagcaggactgaccaagacaagggcagccccatggacatgcacagattgagtctgaatgggcaccacagaacattttcagtagggagctaaaggtaaagataaagtttagcatctaggtaagtcattatgtcaggaaacagtgagttagtggttatctctaagtggtgaatttttaagaaatttttactcc

SEQ ID NO: 392513 - DNA, 478 bp, Homo sapiens
ataggaaggctctggaggggacttaagtcagaggaattccattttctcaggataaagttctggctaattcttttcctctggaaagtaggcttttgttatggagaaggatctaggatcatttcagagtgataactctctctctctgctagagccacagtgagagattcgagatcttaactgtgagaactagtggctttctgagaaaacagtccagaaaagtatgggcttcccccaagattgcagctcagaagttttttattctcacactagtcctcatcagtctattgcattcatcaaagttagcatttaagtatttatattagcttctggctctagcagtttctgctccaggtaagcaggtcttggctgtgcctctttggactcatctgcctctccaaatttcagggttgcaggctgccttatgatgttagctatttgggatacaagataagtcattgattttcactttttccagcta

SEQ ID NO: 392514 - DNA, 566 bp, Homo sapiens
ttatgtagctgtcaagtcccagcccaaatgcccctttctccagtcttccccagctcccctacacagactgaagccccctcctctatttctttttttcttgagaccaagtctcgctctgtcacccaggctggagtgcggaggtacgatcttggctcactgcaaactccccctcccgagttcaagtgattctcctgcctcagcctcccgagtagctgggattacaggcacccaccactatgcttggctaattttttttttttttttgtatttttagtagatagagatggggtttcaccatgttggccagggtggtctcgaactcctgacctcaagtgatccacctgcctcagcctccaaaagtgctgggattacaggcgtgagccaccgtgcccggcctctagtgttatcttattgtgatcagagaagatagttgatatgattttaacttttttgaatttttatttatttattggttcgttcgtatgtttgtttgtaacagagtctcactctgttacccaggctggagtacatgtcatgatcttggatcacctgcaacctccgccttc

SEQ ID NO: 392515 - DNA, 404 bp, Homo sapiens
attggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacatagatttctctttgatgtacgcccatctcagaaagcctaccttcagcagtggcctgtgttaagtgatggttccccgctagcggggaacaatcactggttcccaagtgatggttaagtgattgttaagtgatggttaagtgatggttaagtgatggttaagtgatggtcccgctgggta

SEQ ID NO: 392516 - DNA, 328 bp, Homo sapiens
cctagaacctgtgaatgtgaccttatttggacaaaggatcttttcagatgtaattaagatcttaaggatcttgagatcctgtattacctgggtggaccccaaatccaatggcaaatgtccttatgacacttatgacagaagagaagacacagacacagaggagaaatcagtgtgaagaccaggcagagatcagaatgacatggcttcagactgaggatgctgtcgatcatcagaagctggaagaggcaaacaatggattctccctagatcttctagcgggagtgctgtggccctgtccacacgttcatctcagacttatggcctccag

SEQ ID NO: 392517 - DNA, 273 bp, Homo sapiens
cgggctctgagtgctcttgcccgtccggccccagccgcggcccgggaatctacgtcacccgaaaagcgactataaacgccggcgcctccgtccccagccgcggctcgggaatccacccgaagagtggctataaacgtccgcgcctccattgcgctctcctcttcacttaggacactggtcctcccacgcctgacaccgacgtcgccaggaccgcggggttgggggaacttggctgtcccacgtctttcaaataaagctgttttgtctaactca

SEQ ID NO: 392518 - DNA, 816 bp, Homo sapiens
cgggctctgagtgctcttgcccgtccggccccagccgcggcccgggaatctacgtcacccgaaaagcgactataaacgccggcgcctccgtccccagccgcggctcgggaatccacccgaagagtggctataaacgtccgcgcctccattgcgctctcctcttcacttaggacactggtcctcccacgcctgacaccgacgtcgccaggaccgcggggttgggggaacttggctgtcccacgtctttcaaataaagctgttttgtctaactcaaaaaaaaaaaaaaaaaaaaaaaacgtgtgttgcggccgcgcgcccgggcccccgcggaaaggcttttcagaaacccagtcgcggtgggggcgcgcgggggccccaagaagaggcaagagggaaccagtggggccacaaagggtggttccccagaggagagaaccagcgggccaagagaacaaagaggggtgggattttcctaaccaaattaaaaacggcccgggggggaaaccacgagaggcgttctcggacacaaaaatctccgagaaagggggagatctcgagagagggacacaaacaagggggggacatctatactcaacagaggggggcgtctcccaaagagagggagcgctccgggaatatctcaaaaatatatagcggcccggggaacaacgggggggggggataacagaagcaagaagcgaaagaaaaacaaggaagaccaaaaagcagaagaaagaagggaagacgaacaaacaaaaaaaagacaacaacagacagacaacagagaaacgcacacgcaaaggaaagggaggaaca

SEQ ID NO: 392519 - DNA, 549 bp, Homo sapiens
cgggctctgagtgctcttgcccgtccggccccagccgcggcccgggaatctacgtcacccgaaaagcgactataaacgccggcgcctccgtccccagccgcggctcgggaatccacccgaagagtggctataaacgtccgcgcctccattgcgctctcctcttcacttaggtaggtcctgccgcgttgaccactggcgtctcgctggtggtcttcgagaccggcgttggttgaaaatcgcccccggctttggccgtggccgcgggtgagattcggcgcccagagcccccgggggcctcagctcaccgcgcgctgccccatgtgcggcggtgaaacccaggccccgacaggcgctgccgcctcccccccgggtgcggtcgctcgcgaggtctggcccctgactcctgaccccgactgcagacccctaaccttgttctttctccgcaggacactggtcctcccacgcctgacaccgacgtcgccaggaccgcggggttgggggaacttggctgtcccacgtctttcaaataaagctgttttgtctaactca

SEQ ID NO: 392520 - DNA, 267 bp, Homo sapiens
gcagcaatcaatttatatgtggagacacatacacagatacatacacacacgcgtacacatacacagtaatatggaaacacccaggacacacacttactatgagttggggggagaagtgagaataggttttgcaaaggagttgaaattttggctgaggaggtttccaggtgggcaagtgaggggtggaacattacagccacaaagatctaaagaggcgaggaaagaagggaacatggataatggctgagattgggtgagattaaagtg

SEQ ID NO: 392521 - DNA, 323 bp, Homo sapiens
ggccttctcttagggaatgtggggtgggaggtgagtaacctgctgaggggagtgtggggaccttcccaggccccctggaaggacccaaaatacacaaaaaggggttcagagtgggagggaggctatctgtggggtagaaggaacgtgggctttggagtatgcaggtccgggttcgaattggagttcagccaatgaagtaacttcacctcattagtaacaatgatagcaacaatcatagttttcatttacagggtattactatgcaataggcattgacctaagagttacccatattaactccatttaatccccacagcaatctt

SEQ ID NO: 392522 - DNA, 683 bp, Homo sapiens
aagataggagccctatctttcttgataattatattccaaaggcttggctcccagatccctgagaaagacatttcttagttataaaactgacaagaggttaggaaaagactcacatttcacagggacagggaaatcatttacacttgcaagttttctgaagtaagtgatttaagaaaaggaaagcaaggagcctacagtaaaaaagaaacttgtcgaaagtttattctagctgagaagaacattaaagccatcttgctgattactagcaatggtaattcaaattttttaggtaacatgaaacagtctcatatttaacctggttaagttagatgaagaattattttgatagttggtgtgaagctgtagaaagttctgcctgtggctctctagtggaccacatgtcagggaatgctttctaatttttaggttggtgaaaaagcaatcacagtttttgccataaagtaatggagtttttcactgccatgaagtaatggcaaaaagtgcgattactttttcatcagccaaatattaattctgtgtacccttttcccacaaaatacgtattaatacttagccatgtatttggtgtcagggaaagttgctaccaaaggcaaacagtttttttcccccaccttattattttgacataatgtaatcgttcttatgaatagaattattgggtc

SEQ ID NO: 392523 - DNA, 306 bp, Homo sapiens
atatggtgtagtattcacagcgttgcctcaggggcaaagaggttcactgctgtgctcagcttgctggctgtgatcttgggcaagttacttctgtaagccttggttttcttatcaactctttcaactagtttcttaattattactagggataataacagtaatcaacctcatagattccaagtgaggatgcctgttaatcactcaccacaattgtataaatggctcaatgttcaaaacttgtttatctcttttggaaccgccacttcggtcaaactggtcttcccactgttccttaaatattcggga

SEQ ID NO: 392524 - DNA, 900 bp, Homo sapiens
tgtggtttctaatgattctttgtatttctttcatatttattgtggcatttcctgttgtgtttctatttacattttctcacttttattcttattagtctaggtagtagtttattggtttggtttatctttccaaaaaaatcttttttccttgatttttgtacttttttgttctcagttttgtttctgccctgatctttattatttatttcattttactaatcttgagtttggtttgtttttgttttcctagttccttgagatgcagcattgacttttttatatgaagtctttctagttttttgaggtaggcatctattgctataaaattggctcttcaatactgcttttgctctgacccatagtttttggcatgttgtattacatttatttcaaggaattattaacttccattcttagtttttactttcaaccattggtcacttaggagcatgttgtttaacttccatgaatagtatttgtatagttttgaatgtttctcttggtatttttagttttattccattgtggtcagataaaatacttgattttttaaaaatttttgaggcttgttttatatctgagcatatgatcaatgctggagaatgtttcatgtgctgatgaaaaacaaatgtgtattctgcagctggtggggaaaatgctctgtaaatgtctgttagttctgttctctggtgcagtttaaggctgatttttgttgttgttgttgttgatttactgtctagatgatttgtccaatgctgaaagtgtgagctcaaaaaataaataattggctgtgtgcaggggctcacgcctgtaatcccaacactttgggaggccgaggcgagcagatcacagggtcaggagtttgagaccagcctggacaacatagagaaactccttctc

SEQ ID NO: 392525 - DNA, 238 bp, Homo sapiens
aacagtcccagctactagggaagctgaggcaggagggtcactggaactcaggaggtcgagcctgcagtaagctataatggcgacactgcacttcagcctgggtcacaaagcaagaccctgtttcaaaaaaaatttttttttaatttagccttcccataaatacatacacctaatatgtgcccattaaaaaattaaaaatttaggccaggtacagtggctcatacctgtaatgctagcc

SEQ ID NO: 392526 - DNA, 710 bp, Homo sapiens
aaaatggtgaaagtagtggtcccaagtaccccattaatttgtaagaccatgccagaggcacagtattaatacatcatgtttcttgttctgatgctacattttgaaagcactaacttgtgtggtaaaaggtaggttctaggttctgaggcagagtatgtttagtttactatcagagcctttctttaaagacttgactaaatttagttatcttgaatacatttttgcagtgtctcagtgtgggtagaaaataaaaaccccaatgctttggcatccattgtataccttacttcctctctatggatgacatgtacagtgtacatacatactgtgtactgtgtacaaacatactgtgtactgtgtacaattcttgggagaattgagaaaaagtcaagtcactttcaataaaagagttgtattctcttacagacccccattgagaaaggctggtaggagccaggctatgcactgaattcaggccatggatttctgtcacccaggctgactgcagtggcatgatcatggcttactgcagccttgaccttccgggctcaagcaattctcccacctcagcctcctgagtagctgggactacaggtgcatgccacttgcctggctttttaaaatttttttgtagagttgggggtctcactgtgttgcccaggctggtctcaaactcctggcctcaagcagtccacctggcttggccccaa

SEQ ID NO: 392527 - DNA, 168 bp, Homo sapiens
aaatatagtggatatgtgccaattaggaaacagaactccatccactccatgtgttttttgcaaccgagaaagagagagatcactgtgtactgatgtcataaagaagaggttcatgggggaagcagagcatgaaccaggcaaagaaagatggagagaggatagttactg

SEQ ID NO: 392528 - DNA, 331 bp, Homo sapiens
gtgattagaggatcccaggcgcggtctgaactgcaaggcaggtgtggggaatccagcctggaagtgactgcagcctagctgagagagccgtggtggccaggaccagtgaggcagcagcgtggatggagagagaggagggatgcagagatgtttaggacatgagctggccggtgatggatagcatggggtaggctggtggtggtgagggggtccagggtccagctgccactaggagggtgggtaggtttggggacaaccccttgtctttctgatccttgttcaggtgagatccccctgcacaaatttcacctgctttttttttttcctgagc

SEQ ID NO: 392529 - DNA, 427 bp, Homo sapiens
tgtcttagtgttatccaaataagtttagggaggataagcagtgctttgtgggaaggataaacactgtatagcaggaagtagcaactccaaaatgaaagaattgatgagcagcataccgatttttaatctgagctcagagtttaaagaaaaaatgggaagttaaaagtggtgccaaaataactgaggtattttattgttaataaaaggaaggcgatgccatttaaaaacgttataagtcagatttacaaacactttatagttgcatactctaatggcagggagtaactggcgattctagacaaaaagacaaagtcttacaagggtaaggagagataagagtttgtatacaggaaagagaagtaaatctatttaaaacatgtctagcaaagaagagaatttaagtggagagaacaaaaattggaggtgt

SEQ ID NO: 392530 - DNA, 671 bp, Homo sapiens
cttaatagtcgaaataattaattaaaactatatgaagaattttaagatttattccaaatacttttttcctttctcagttattttgacagtttcttgtgatgtataaacagatattttgcatagcaaaagactttgatatctaatattgttcttcatggactggaattatttaattagcctgaatgcagtctaacttaagtaggctttttatatagttattataatggctatatttgaaaagtatgctttggcatagtagaaactgccagatgcaatgccatttgatctaaaaaggtcacgggaaaagggacatttaaattaagttataaattacaattgaagaacaatattttgatgtgtgagaccagagatgtcagagcagggagatgtaattcatgggttcattatagaacagaggtgcctgacagctgagccatgccaaaaggaaaatttatttgcaacatcacgcagacagaaaatggtagctaagatgagaagccagaatagaaacttgaaaccttgtggtaatacgcagagtttatgctaataagactgcctgagatccagagatgtttaatgactgctgtaatattaatgaggtgcttggacatgtgcacattttcaatcttataaaaattaaggcctcatccttgctctataaaataacatgc

SEQ ID NO: 392531 - DNA, 476 bp, Homo sapiens
gggcacttactctatgggtgtccactgaggccaggtgctgtgccaggttctgaggatacatacggaggtagcagcaggacagactgtttctctctcaagggccttctgctctggaagaggaaggcagacagtacataaggtaaacagtataacaagttcccagcaagatgatactgcactgtgtttagtaggaagaagaaactgatcagggtaatgagatgggggtgcaggcggaaggggttacttcacttgacgtgggaggaggagacatttgaagtctgagggaagcgagttccagggagaaagatcagcaaagacaacctcaccgaagctaaacaagtttggcccgctctgaggaaggagggtcggcaaagctgggactcctttaacaggaggagaggagggagaaatgtgttaggattttaggcaggaaacaaaccttgcagggcctcatggccatagtggagagccgtctc

SEQ ID NO: 392532 - DNA, 273 bp, Homo sapiens
acatatgtaactaacctgcacgttgtgcacacgtgccctaaaatttaaagtataataaaaacaaaaatgaaaagaataaaaatatgcatgaattaaatatcaatgctatcaaaacagttgcaaaataaatgagagacaaaaataaaaaaattaaaaaattaaaaattaatgggttataagacaatattcacaagccttatggcaacctcaaaccaaaatgcaaacaatggatacacacaacattaacagcaagaaaccaaattatatcacgtg

SEQ ID NO: 392533 - DNA, 720 bp, Homo sapiens
gtctatctccttccaggctctgtgaagctggtgaccccggaggggtccccagtccggggacttcgcacacctgagatccccatgaccgaagcggtggaggccgtggtatggttggaggtcagcttcaggccttctggaagcatggagtgcaggtgtgggctctaggctcggatcagcatgcgtacgaggagcatgagagacctttacccctctacattaccagtcgtgctgtggatcgccccaaggttcgagagtgattctcatgcttcgagcctcccaggtagcatgggtttacggggcctgtagtggtggagacactgccctagtggaagtgatcctacgtgtttcccagctagaccttctacatccaggaatgagtccctaggggggtgtcaggaaggctagtccttggacctcgcctccccccatagacacactatggtggtcatggcatgtcctcatctcccaataaacatgactttagtcctctgcatgtaaacatttgattaccctaaaattgttctgacaattgggccagatgtactaagcgaggggcagaaagtgggggatcgaaaagattgaaacaagagtttgaaagagtcgaagaaaggttgtctccaaccagccttgtgttgatggaccgtgaggggatcagtagggcgtgcctgcaagacgggggaatttaacaaaagtgtggacatgaaaggagtcctcatgtga

SEQ ID NO: 392534 - DNA, 627 bp, Homo sapiens
tctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggtttttctcgtggggccacacctttctagagtggtggttgatttggggatgcgtctccaccccactggctgttacgagaggaacagaagcctcctgggagtggggataggggggcc

SEQ ID NO: 392535 - DNA, 623 bp, Homo sapiens
gctttgaacaatggagattgaaaggcctcagaaataagctcagaaccaaggcctctctccaacttgcttccttgccctctttcccttctgaagcatgggggtgggctctctctgaaggtccctcatctgacctagggaagttcctctggaaggaatgcatttgtcttagactcccctccctaggatttatattaatcacagaaaattaactcttaacataggagagaaaactcaaagtctccatgcccaggacagacttcacctattctttcaactaaagggctgttacctgagagacttaatctgcataattagacaacctttgttcacagtgcacttccacccctcaccttcccataacttgtcactacctcccccagggcccataggaacttagtcccagtccattgtctgctcttgagtccactcatctcctcattgaggggtccctctccacacagactgatggggctcagagaggcggcccctgcagtccccatgggacagctctgacccggccctctcaggcatgctgtgctccttcccatgcaattggcctcaattttcacttttgtttctgagtggtgatggggggaactgaaatactcaaatgcttgtaaata

SEQ ID NO: 392536 - DNA, 284 bp, Homo sapiens
ctgtaatctctgcactttgggaggccaaggtgggaagatcactggagctcaggagttcgagaccagccttggctacatagggagacatcatctctacaaattaaaataataaaataaaattagcaaggcatagtggcgggcacatgtagtcccagctacttgggaggctgaggttacatttttcaatgtaatcttctaagtcactgtttattccacacggtaagatagctcatcaatttagtttttttgaccaacattaacaagaaacagtatcatcacaagat

SEQ ID NO: 392537 - DNA, 481 bp, Homo sapiens
gtaaaaactcgtgggatgagcaaatgactctgaaacggtcccatgcgggaaatgtccatgaagtcctggattttatctaaaaagcccaggcaggggtggggcgggggcggcggggctacagttccacgctgagctgcctcctggccgctcgtccccgccgcagtgcctgggcggcccgggcgcccgaccttggccgtggacaccttcgcggtgcgtgctgctcctccccatctgccactggaagatgctggggcgacccggctccaggtttagcaggacactgagaaaagggaatggctgcctttcggaggctgggtgagcccttctctgtgcctcacctgcccgccccacagcggccctgcacctcgtcccacggggcccattgccccggtaggatgcgcgcttttgttttgagggtcaggcatcttccctgccgtcgtttctgggaggttgaaaaattgatccagaaagacctaaaaca

SEQ ID NO: 392538 - DNA, 401 bp, Homo sapiens
ccccaggggcctcatcctctccacctgagaaggtgtgtaaggtgtttatcagcctccctgccccagggcagaacccacaagggcgcagaccctaaacacaagggcgctgagtgtgtgggggaggactgtatgttaaagatgccgagcaaactcaaccctcagccaacaaaagttatagagcaacatccaagaaggttcaggccagcctggcgcgggtgacaggcgggtcgccattcccagctgctccagtaaacctgatctcccaccacagggcaggggcaccccaaggtcacctgggagctttcgccagaggggacacactggtcccgctccttggccacggggaccaggccccggaagcacccccagggggcagcggccatgctgcccacccatcctca

SEQ ID NO: 392539 - DNA, 1348 bp, Homo sapiens
taaaaagcaaaagaattcgcggccgcgtcgacacgggcttccccgaaaaccttccccgcttctggatatgaaattcaagctgcttgctgagtcctattgccggctgctgggagccaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctgg

SEQ ID NO: 392540 - DNA, 1702 bp, Homo sapiens
taaaaagcaaaagaattcgcggccgcgtcgacacgggcttccccgaaaaccttccccgcttctggatatgaaattcaagctgcttgctgagtcctattgccggctgctgggagccaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctgggccaaaaaaaaaaaaaaaaaaacaaaaaaaaaaattgtgttgggggcgccgctgcggcccccggagaagaggcttttagaagacactgttgttggggcgcgggggcggccccccgacgagactgataaaggtagaacccggtggccccacagggccgggtcccgagaaggaaaaacgccggggacacggagaaaggtggtgtgggatatttcccccccaattaaaaagcggcccgggggggagacagggggggcgcttctgaacgaaaaccgaggaggggagctgcgaagggcacacaagggggacctcactccaacgggggagccagggaagggcggaaaacaaatagagcgc

SEQ ID NO: 392541 - DNA, 1339 bp, Homo sapiens
ctctgtcctggaaacaggcttcaacgggcttccccgaaaaccttccccgcttctggatatgaaattcaagctgcttgctgagtcctattgccggctgctgggagccaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctgg

SEQ ID NO: 392542 - DNA, 886 bp, Homo sapiens
ctactctaaaatttatttactgaatattccatgagtgtccaggaagtaactgagacttgtgtatttaatttggaaatgagacttctgagacaatcagatgcagacgaaaaattatttgcttcactattatttacttacctgagtgaatggtccttaatgttgtaaatatttcatttgctaactagctttcaaggtggcagaaaaggtgttttacttgaagaatttgaggagagggaagacttactgatttgcattatcagtcagtccccaattaccttggcataatcagtcccattatttagtgttactcatttttaaccagaactgtctgggtgtatcagagcacaattgggaagatgggctcttaatgtagttcagcctcctttaggggcctaatgaaggaagacttataaatacttctcaattatccttcagatgaattagcagcagttagcccttgttccagcgcagtcgattcttcaccagttgacttttccattcttcttgggaagcgcggcttaaaaagaaagtgctggaggtgagatgtgcgaattaggtctttccttgcaagtcatagatgctcggcaaagtaagtgtgcccggaactctgtccctacctctgcaggctccacacacgtttggagaccccacccccagcttgtggaacctattgcagtatatcatgtcccatgttgaacacaatcgtatataaggataaggacacaagagtggtggctgcctaactgatatggtggtatgttctgtagcagttgaaaaagcattgaaaaagcaattttgaaacgttctatttcggagccagtaaattttgtcttcatctcatttctgaggggcctgaagagttaaagggccctgggtgctccacctg

SEQ ID NO: 392543 - DNA, 241 bp, Homo sapiens
cctgtcttgggggactcggagagtaggagctgggaaggggagaggggctccccggacagagtcgtctcatagggaacagcacctccagccaggctcggcactacaccaccccaacctggccttggcagggaccctggtgctgagccctgcttgtcctgaggcctcattctgccctgtcgctgctggcaacgcccatgtctggggtgttgtgaagaccccaaagccccttgtccagagcctt

SEQ ID NO: 392544 - DNA, 646 bp, Homo sapiens
gaactaatcaggtacacctaagagcttcctggatatttccaccaggttgtcacaaggaatctcaaacgtaagaagtcaggaaagatctcataatctccccttattttattttattgggtaattgtcaccaccatccatttatttggtcaaaagaagtgttgaaaacatcccgacttgtacctatttcttagatctttaccctgccttctccttctgactcctgtccttcactaacagtatctaatcagtaaccaagactcattcattgtatttccttatgtttgtttcctgctctcagctcttgcagccctacctttggtcctcaattttctcttgcttgaattattccaatagccacaatgtaaaaatcacccagtgctggtcttgctcttctccaaaccattttcacagtgcgaccaaacctatctcactaatctcttacctctcacatcaaaatccttcattttccacagcacaaagtaaacactcaataactacagataactaaacacatttgcattgccatgtgaagtctcctgaatctggtcctggtttgtgtttgtccctatttgtcagcacacgtctctggaatgacagagtcgtagctactaggaagagagtaaggttacgggaacatggcgaaacg

SEQ ID NO: 392545 - DNA, 346 bp, Homo sapiens
ggctggtctcaaactgctggtctcacacagtcctctcacttcaggctcccaaagtgctgggattacaggcgtgagccatggtttcagctgaaggttgcacttttgatctgttctgttggtgtgtttcccagcatgcattcattttctaggggtgactactgtttgtagtatcttttttctcaggatagcattgtatgggatttgatctcagggctgttctgttgctcatttttatgtgaaattagttttcctagtctttcagaaggaggatggttcggggcagcttttcgacttcatggtgctccctcttggctgtgtgtgtgtgtgtgtgtgtgtgtgtgtgcag

SEQ ID NO: 392546 - DNA, 362 bp, Homo sapiens
tggcccagccctggatcaggacttttcaggtcccaggcagggctggcagtcccctcccattaagaatcttcaagtccgggcatggttgctcaggcctttaatcccagcactttgggaggctgaggtgggtggatcacctaaggtcaggagtttgagaccagcctggccaacatggtaaaaccccgtctctactaaaaatacaaaaataataataataataattagctgggcatggtggcaggcgcctgtaatcccagctactcaggaggctgaggtgggaaaattgaaccaaggaggcagaggttgcagtgagccaagtttgcaccactgcactctagcctgggcaacagagcaagactgtc

SEQ ID NO: 392547 - DNA, 370 bp, Homo sapiens
ccagtcgcttgttgggagagcaaggtgggtacagagggtaatggaagataacaagggaagaacaggcccacctggactgagaagtgctttcgaatacttgcttaagttctatggcaggcaagaggagccaatgataattgagcaggggcaagatgctttgctttaggaagcttgagcagaccacaatgcacagaatgagatgggatcatatactcaaatgccttcaggagctaggcagagaaaataaatgtgtaattgaggtcacataaaacaaagaagagtactgggctaagaaatggagtgtgcaagtcctgaccacaggcgctaaaaattaaattcctgaaaaatgtcttggccaacaagcgcctgg

SEQ ID NO: 392548 - DNA, 386 bp, Homo sapiens
gacatgaggacagggatcataggccaagagtcctatacaggctgaaaccacagtcatggtaggtaagcaagtagcaatgaactgtggccaaggcaccaaagcatagcaacaggaaagaatggtacaaaaaaacagatgagagaggtaggaaaaggacccagagtgatgagccagacccaaggtggagaagactattcatgacaataactgctatggagaagtcaggtaagaggaagtcacaagatgggccaccgggcagtcaggtaagaggaagtcacacaagatgggccactgggcatgagtaggtggccagggacctctaggagagccagctggagtgagagtgggctgggctgaaacgctccactgttgttgagctggcaagg

SEQ ID NO: 392549 - DNA, 890 bp, Homo sapiens
  misc_feature (790)..(790): n is a, c, g, or t
  misc_feature (807)..(807): n is a, c, g, or t
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgtactatganttccatggccgagttcnacggtgtaaacaccgggggaagcgggagacaatcagaaccacggaagactctaggaattatggggccacaagattgtccacaa

SEQ ID NO: 392550 - DNA, 157 bp, Homo sapiens
attcaagcttctaacgatgtacggggacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392551 - DNA, 1225 bp, Homo sapiens
agcgggagtgacgcgaggcgtagcggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392552 - DNA, 1541 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaa

SEQ ID NO: 392553 - DNA, 1211 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactggtctttgattattgacttggcggattgggtttaatgggctgtctgtccactctaataacatttgttcatccc

SEQ ID NO: 392554 - DNA, 1487 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaaagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaa

SEQ ID NO: 392555 - DNA, 1183 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtgtgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392556 - DNA, 1334 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccagggctctgtggattagactcacctctgcttcttggtgtgtggggcctcagctgagatgactcaagtggctgggggctggaacagctagttgtcaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392557 - DNA, 1430 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaatcacttaaccctgaaagtcttgtgagaagacatggcgagaagtggagtcaagcacacaccatgatggcagataaaggaagagaggccgataatcttttttttttgagacggagtctcgctctgtcacccagtctggagtgcagtggtgccatctcgactcgctgcaacctccgcctcccaggttcaagaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392558 - DNA, 1165 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392559 - DNA, 787 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtgctaacacgtggatactttacttctgggctggggct

SEQ ID NO: 392560 - DNA, 963 bp, Homo sapiens
  misc_feature (19)..(19): n is a, c, g, or t
tgacctgaggatccccagntctttcccctcaaagaatcatactgtcaagacaggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392561 - DNA, 1193 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaaggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392562 - DNA, 1168 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagctgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392563 - DNA, 1143 bp, Homo sapiens
aagcagtggtatcaacgcagagtgcccattacggccggggggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttgtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392564 - DNA, 793 bp, Homo sapiens
  misc_feature (722)..(722): n is a, c, g, or t
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttgggggtgatccaaagggccttcaaggttcccccctttccacttaattttaaccccctttcttccccttttttnaacacatttacgttgttgccccggacgcagggtccacccttttttcccaggcaccttttgcccttttttcc

SEQ ID NO: 392565 - DNA, 641 bp, Homo sapiens
  misc_feature (333)..(333): n is a, c, g, or t
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagttcnctactggtcaaagacaagcgggttggtttccccaaagttttgggaaaaaatttttttcccaaaaaattttttccccaaaaaagggggggggaatttttaatgtaagtaacaaaaagagttttcacacaaattattttaaagttaaaaattgtgggggggggaaaaaaaaagaggggggagaggaggagaggggaggattttttccacaaaaaaagagggggggaaaaaaaagggggggtgcacagatcagaaaatatttttttgagaaaaggggggggggaaaaaaataattttagggggggagaaaa

SEQ ID NO: 392566 - DNA, 184 bp, Homo sapiens
gaatgggtcaattttgcttttgtttcttggccaggaatcacttaaccctgaaagtcttgtgagaagacatggcgagaagtggagtcaagcacacaccatgatggcagataaaggaagagaggccgataatcttttttttttgagacggagtctcgctctgtcacccagtctggagtgcagtggt

SEQ ID NO: 392567 - DNA, 1240 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392568 - DNA, 1773 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaaaaaaaacaacacagacgccgacacccaacagaacaccaatctctgacagacgaaaacaacaacaaacaaaaaaaaaacaattttgtggggcgccaacggccgccaccaggaaaaaagacttcttaaaaacacaccatcgtgttgggcgcgccgcgcggagccacagagatgatagagcaacaaggggtgacagacggtgtgtccccaagagaaaaactcgggccaacaacaa

SEQ ID NO: 392569 - DNA, 1203 bp, Homo sapiens
aagcagtggtatcaacgcagagtgcccattacggccggggggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392570 - DNA, 1544 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtgtgttctagcatgtgattacttcactcctggactgtgactttcagtgggagatggaagtttttgtggtgataaataagatcgaccaatgcaagtgttcataatgactttccaattggccctgacagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaa

SEQ ID NO: 392571 - DNA, 1180 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttgtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392572 - DNA, 1217 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392573 - DNA, 1196 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaatggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatca

SEQ ID NO: 392574 - DNA, 788 bp, Homo sapiens
  misc_feature (698)..(698): n is a, c, g, or t
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctccttttttgtggngataaataagaacgaccaatgcaggggtcaatatgactttccaattggccctgaggtctaagatgggatacctaacttctgaactgggat

SEQ ID NO: 392575 - DNA, 1092 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggtgttccaatgaattcactcaggtttctctttgagggtcagagaattgctgataatcatactccaaaagaactgggaatggaggaagaagatgtgattgaagtttatcaggaacaaacggggggtcattcaacagtttagttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatcatgttgaataaatgggcatgccaaaaa

SEQ ID NO: 392576 - DNA, 531 bp, Homo sapiens
aagcagtggtatcaacgcagagtgcccattacggccgggggaagttactgcagccgcggtgttgtgctgtggggaagggagaaggatttgtaaaccccggagcgaggttctgcttacccgaggccgctgctgtgcggagacccccgggtgaagccaccgtcatcatgtctgaccaggaggcaaaaccttcaactgaggacttgggggataagaaggaaggtgaatatattaaactcaaagtcattggacaggatagcagtgagattcacttcaaaggtgttccaatgaattcactcaggtttctctttgagggtcagagaattgctgataatcatactccaaaagaaaccgggagatcttggctggggtgcagaccttaccagtgtaggtcttgagccccgccctggagtttattctactggcaaccccacctttcttctcactggttttatcggcaaccgttttgtatttttcctagttgcccctcgggagactgttttcaaggccgcctttcttaccttttctgggacg

SEQ ID NO: 392577 - DNA, 477 bp, Homo sapiens
agttccccacctgcccctcattggagatgagaaaggaaggaaaaacagagctgggcttctgtggtctttgtcctgtccccaaagccctctggaaggaatagagagaaatcataggatgaggctttctactcagaccccatgtaactgcccggccaaaatgggccaaggtaggcagcatcccgctcaggtcctgcagatgctcacacaccctgctcccacctggccaagagcacccctcctgttcctcggaggactggggagtcccaacttccagtcgctcttcccttaggactcacatgcctttgctcccctccctgtggcttcgctggtgcttctcaccatacccaaagctccaccaccttactgagtcacgcatttacattgtgcagtactgctctgggaccaggaaaatgacccactaatagcttacaaccgagcatgggccaaggtatggttgtaatgcaggtgaaatgtgaa

SEQ ID NO: 392578 - DNA, 327 bp, Homo sapiens
ctcagagcccctccatgtgatctcttcagcagggtagtcggacttcttaaatggtgactcagggctctaaaaaaaaccaaagcagatgtgaccagtccttttaaattgtagtcctaaaactagcatagcatcactttgaccatgctctaaaggtcaaaatgtaataggccagtcatagatcctacctctcaacaggaggaatatcaatgaatttgcagtcatctgtaatctgccacactctctggttcaggattttcaagggggcaaggtctgatgcatacatccaagttgttctccttctgctcctctactgtgtgggccaatttt

SEQ ID NO: 392579 - DNA, 361 bp, Homo sapiens
aatggataaaaatgcaaggcccaatgagctgttgcctaaaagaaacacacttcatttataaagatacaaatagactgaaaataaatgaatggaaaaagatatttcatgccaatgaaaacaaaaaaagagcaggagtagctatacttatatcagatgaaataggtttcaagagaaaaactgtaagaaaacacatataacgtcactatataatgataaaggggtccattcagcaagaggatgtaacacccagatataaaggaaatattattaagagctaaagaaagaggctgggcgcggtggctcacgcctggtggctccgcatttgggaggccaatgcgggcagatcacgaggtcaggagat

SEQ ID NO: 392580 - DNA, 429 bp, Homo sapiens
ggggggagaaaaggtgtaagaattaagaagccaccctcatgctgtgataaacatctgcaagcttcagcaactgtcagctgaagcaatctgaatactaaacgtttttgtgtcagaagagagttacactgaaggcctttgacagtggtgcaaatgtgggaggcataaagctgatacttggggaccggatgagagttgtgactgggcctgcatccaaatgcctgctgtcaccagtgattcagaaacagtggactcacacaagagctgagaggaggtttgggccccatcagtactgaccacatcttaaaaggaaacctgatttgtggctcctagcaacctaaaatcatagactgttcaaagaaactagaaatgtttctagaaaggaagcttagggccccacataaacatcctcgccagggaaagaaactggga

SEQ ID NO: 392581 - DNA, 1989 bp, Homo sapiens
  misc_feature (1)..(1): n is a, c, g, or t
  misc_feature (269)..(269): n is a, c, g, or t
  misc_feature (1249)..(1249): n is a, c, g, or t
  misc_feature (1251)..(1251): n is a, c, g, or t
nggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaacgttggaaccaatgctgatgagccattcataggctctggctcactatatatgtctaaaattcacatgcccctaaccctcanataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctatggtgggtggggtccaagcctccctgaagcagatctctatcctgtcaccctgctggaaatgaaacacttaggggttagaaggggatcaaggaaagtccgagagttggttgtgattatcttcagtcagaaagtgcctacttttccaagcatccagactgcaacctgtctttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgcncncagatagcctcttagcagagccaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccgtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaagaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagatt

SEQ ID NO: 392582 - DNA, 545 bp, Homo sapiens
gccgcagccgggcagaaatatccactagtcagcactccggcgaggaactccaagaggccaagtggaggatgagagctgctgcgaagactgagtggggactgactgggggcggacttaaaaaccaggcagaccggaaggagtggaaaggcaaaggccaaggttggaggtgtcagcgtcctgctggggcgtactggagaatggctcggtggcaggtgggcgggtgggatccactactccaggcagagccaggcggcagctgaatggcagtagtgtgtgcgcgcgtgtcaaccccgctcgtctcccggataagccgcagctccgcggcagacacctgatggcaaaggtagaagaaacaagagccgggttccggagggcgcagagccacggccggcccccggcggtctcccactagtggttcgtccttctcaaagtgcagcaacttttcccaggctttgaattccgtcccccaaggccacagtggcggtacccctgccggcgtggcgacgccgcccggctcctggcgctgcacctgacgcggcggccgc

SEQ ID NO: 392583 - DNA, 364 bp, Homo sapiens
tggtggttgcatagtgattgcagatcccagcttcttctaccttccattctgaagactgcctcatggtccaagatggcaactggaaatccagccatgaaatgtccacatttcagacaaaaaagaaaatgctgtaggacgagagtctggggaagcacacaggatacgcctcccaagagtaactcatatagaaagttccctgagagcatcaccaagtgacttctgcctatagccccttggcaacccctaactgaaaagaacaggaatgcagtacatgtgctgtgcaccctgtcacatctgggttctataaatacagaagggacaatagatactgggtagtgcattaatcatgtttattttctgtatt

SEQ ID NO: 392584 - DNA, 147 bp, Homo sapiens
atagatcgagccggtaccggttcgcatgttccccaaccctctttctcatcagactacactctgcttgcccttcaaggctcagcttaaatgacactttctcagcaaaacctttactgacctcccagacaaaattagagcctgctgtta

SEQ ID NO: 392585 - DNA, 441 bp, Homo sapiens
ctgatgaaatccatggaaagaatgtggggttagaaggtggtcatgagtgcaaattctggatctgctctttactgctgtgtgatcttgggcaattaaccttttttgagccttggtttcttcttagaatgggagtgacaccttctatgattgttgtgaagattaaatataatgaagatgtaactgcctggtccctgataaactgtcacaatatgttgagacatattgtctcaacatacgtcacatatgttgagacaatatgtgagacagagtctcactctgccccccaggctggggtgcaatggtgcgatctcggctcactgcaacctctgcctcccgggttcaagccattcttctgcctcagcctcccgagtagctgggattacaggcacctgccaccacacccagataatttttgtatttttagtagagatgggatttcac

SEQ ID NO: 392586 - DNA, 172 bp, Homo sapiens
tgccttggcctcccaaagtgctgagattataggcatgagccaccacgcttggcctagaccaagcttctttaacacagagtatttctaatgcttagtaagatcataatacttgtgagtgcagtgtataacacttgcatgaagctcctcgtacgtacacaatgctgttcaattc

SEQ ID NO: 392587 - DNA, 360 bp, Homo sapiens
gtggaataagttcaatggtagacgcacgctcagcaggctttgcgggcacagcacagcccttcggccaggccggaaggtcagggaaggctgtccagaggacgccatgtatgagctcgctcttgtagacaagtaggaactagccaagcaaaactgagaagtgtgttcaaaggaagggcccagttcaacaagcgcacagagtttggtccaactggcgtgtcggggttggagagttactcaaatgtctgacctggtgggggcacagtgtgccgaactcaggaactggaccttcatgataaaggctgtgtgggaggagtgagttagggtcctagggctgctgtcacaaaggaccacacaccaggg

SEQ ID NO: 392588 - DNA, 534 bp, Homo sapiens
tcaacgctttatacttcgtatgacttccctcatgccctggcataaaggcacctttcttagaaaagccctgaagtgtgggaaaaggacaggtctcttgttattttctctcaaaccaacggaattttcattgtgattctgattatttatgtgagtctttcccactatggtaagtttgatgagggaagggtcacatttgttatggtttactgttacattctcaaagtctagaactgtgcccaataaataggtgtttcttaaatttgctgaacaaattaaatatgaattttaattatgtatatagcgttaaaacataacgatgcctttatgggcaactcgtgaagctcagtaaaagaccatccaatcatcaggattcaattgccttagctacatctccccttttgggagggaggtgggaggaggacttctcaaatggtgagacggtgtacaatatgctgtctaattctaacgtgaaggataatttgtgaaatcaatcggcttaatgtgaactaatcagttcaaaatctcagggaagta

SEQ ID NO: 392589 - DNA, 464 bp, Homo sapiens
  misc_feature (83)..(83): n is a, c, g, or t
  misc_feature (99)..(99): n is a, c, g, or t
  misc_feature (114)..(114): n is a, c, g, or t
  misc_feature (117)..(117): n is a, c, g, or t
  misc_feature (126)..(126): n is a, c, g, or t
aactcctgaccttgtgatcctcccgcctcagcctcccaaagtgctgggattacaggcgtgagccactgcgcccagccgtgtcnagttgagtttttaaanacaggaagtgaccanaanatcggattnaatgttttaggaggatacctctgaggcatctggcatttgtattagagaggtctaaggacaagctctaaaatgccattttgatacatctgtttcaacattctacaaaaattcaaattataccctagggttgagaactattggaatagtaagaagtccacacttactgcccttcagactaaaagagaaaagcaggaatctaacccttgaccctaaacaagaaagtcctggactgctgaggccagtgattaggaaaaagaacttgcaatacattgaaccctttataacttttctttattgattgtttctgttttcctttttctttatttttttttattttt

SEQ ID NO: 392590 - DNA, 1285 bp, Homo sapiens
cactgctcacaattcatagtccagggaaagaatgtccagtaggcctgatgtaggtcatgttcccatctcttgtttaggagtgagtgtgaacctgattaattgtcccacaagactgtatcccatgggggagaggtagcccccaaaaaggtaatgaggataatggatactggtaccaagaggaaaggactcaatgataggtagtcagaaatcatagattgcccatcacatccatttgctgagcatttcttcaggttgggaagcatctgatcactgatcacacaaagaaggggaaattagaaagggagattcttcagcttaggtcaggctacggactgggtgggagcagtggctggaagaaactcagtaagtttaggtcaggctacagagtgagtgggaagcagtggctcactattgtcttcctaagagagtagacctttctactgtatttctggatcacttgggtaaagttgaggcaaaatgtctcttctggttctttgtcatactgtgattaaatgatttgataaggcttttgtagctcattatagtcatgatgtattaggaagctctttattttttatagtttcaagaagttatatctggccaggcgtggtggcttatgcctgtaatttcagtactttgggaggccaaggtgggtggatcacctgaggtcaggagttcaagaccagcctggccaacatggtgaaaccctgtctgtactaaaaatacaaaaattagccgggtgtggtggcggacacctataagcccagctatgtgggaggctgaggcaggagaattgcttgaacccaggaggtggaggctgcagtgagctgagatcgcaccactgcactccagcctgggcaacagagcgagactccatctcaaaaaaaaaaagaatttatatctgttttctcgggagtcttttcctatttaatttggtagttgttgtaatttggttggcatgtaaaatctgtccctcagtattatatctatctagcagtaaagacaagttacgcaaacctgttgggtgacctttatgtgactgtacttcctggccctctttgttgccagaacttccgtttgtttttccacttacactttattgaatgggtatgctgagtcatggtgggtatcctaatctaccagcaccaatcgcaggcttgtcacgaggcccacgtaaatagcactatagtcatagtttaattaactgatcttaacattttatattaattatttcaaccattggaaacatgcctttataaaactctttaaatccccaagtttaata

SEQ ID NO: 392591 - DNA, 437 bp, Homo sapiens
cagggttggttacctgggttttctatcagtttttgtgtgtgtgtgagtgtgtttttaaacctagtataagttaggtaaagtttatttattcatttatatgtttggagacagagtttcgctctttgttgcccaggctggagcgcgatggcgcgatcttggctcaccacaacctccacctcccgggttcaagtgattctcctgcctcagcctcccgcgtagctggcattacaggcatgcgccaccacgccccgctaattttgcatttttagtgcacaccgggtttctccatgttggtcaggctggtctcgaactcccgacctcaggtgatccgcccgcctcggcctcccaaagtgctgggattataggcgtgagccaatgggcccggcatggtgtatcttactaccattccagtagcctccagatgggccctcctgcct

SEQ ID NO: 392592 - DNA, 181 bp, Homo sapiens
tatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctca

SEQ ID NO: 392593 - DNA, 132 bp, Homo sapiens
cattaaagctgagtgcggtatggggggaacctccagtgcagtctttagagtgactccatcacttcaatctgaagttttgaattttaattccatcatccaacatcttaatccttttagtcaagacaaccaaaa

SEQ ID NO: 392594 - DNA, 701 bp, Homo sapiens
ggtcttctaggatcttaaatttatttatagacatctggcactgaaggaagtttgagctaaaataactaccaaattctcaacagtgtcacgcatgttacacatgcacagcaaaattacaactagaaaccaaggctcctatccctacatttcaaatagcatttctctcacaattgattatgtattaaggcttgtcaacgaaaaggaaacttttttctctcagaatttctagaacttttttctttaaaaagttttttattctgtagccagaaaaatttaaagtttgtgctgggttgctttggttatagaactaatgaagcttgagtaatagtttcagacattctcagggtttttcttctgcagccagattttacacttctgttatctcagctgtcttataaatgtattccctccatcacacaatataattagaatgtattgatgaacagatgtaacttcatcactagagagacgttaaataaattatgtgttggtatcatgacttttatcaaatcatgaaggatgccatcacttttatgtgatagtccattggtatagtactaaagtttgtaagtaaagaatgtcagatagataacaagataacttcattttcgagatctcataacctgggccttagtatagttaaattgctatcagtctgttccctgtaatctccaattgaagtagacagttaaacaatgaga

SEQ ID NO: 392595 - DNA, 644 bp, Homo sapiens
aaaaaaaacggaaatggcaaaggcccaggcctagctcctgggtgtccctgtaagttaggtttggtaggcccaccagaggcctctccttaaaggagaacatttagaagctgtgcccactgttggacatttttggccatggtttatctgggcaagggaggggactgggctgggggctttcccagagcccctgccatcagaggctctagaaaggactttgggagccattaaagcatcttcaattgggaagttgtagtgtgtgtgatctggctgctatggggagacaaactgtgggtttgagggcaaataaacggagaccaaggtagaagcaactggactggtctaggtgagtcctggcagggcactggaggcagtggaggttatgagatgtggctgattctagagtgttttggaaatggtatatatggaccttaaatcaagagcttaagggtaattcggatcacattagccatgtaggtcacgataaattgttaatttgtagagattttggtgccttaatgtcagcaagtgttgcacaatgagtttctttttatttattttattttatttttttgtgatggagtctcttgtcatccaggctggagtgcagtggcgcgacctgggctcactgcaacctccacctccca

SEQ ID NO: 392596 - DNA, 780 bp, Homo sapiens
ggaatttaagaacaacaacataggtagcagaagagatagctatccctgattattttgtactagaactttaaaatagctgaatttttgtgaaaccccccatggtgagaaaccaaccttgcttctcactccttaattactgttttagcatagcttatttgaaaggtgtatccaaaaatatgttttcctgataccatgcttgtgttattttttttaaatattactaacacaagctgctgtttttatttctaaagtgtagtgttttgtccttttaaagtacatcttcaataaataactttatacttgattttgtaatcaaagaaaaaaaacacacacacacaaccaagaattaaaacacagaaggggccagggtagggtagttcatgcctgtaatcccagcattttgggagggtgaggcaggaggatcgcctgaggccaagagttccagaccagcctgggcaacatagcaagaccttatctctacaaaaagaaaaaattcgccatgcagagtgggatgtacctattcaataggctgaagtgggagaatcacttgagcccaggaggtcaaggctgcaatgagccgtgattgtgccactgaactccagcctaggtgacagagtgagattctggttctgaaaataaaataaaataaaataaatcacagaaggaataaatgagaactgaaattagtttctgtgaagtgactgatggttctgaaagtatatcttaaacactattaatgaatggttttatttttcacatcaatttttgataacttaagaa

SEQ ID NO: 392597 - DNA, 301 bp, Homo sapiens
gtacgcttacatatgagtgcccagtcagtattactccggaaccattggaaataattttcgactaacttcctcatagcccaggtttggtcctaggcacacagacagcatatgatgaatgttagctatagagattccagggctaaacagttatgtgcaacctgaattactaaacacagtgggaatctcctcaagtgggcccggaaacacagtgggcacaggtctcctgtgtgcctcttccagtaccctgcactgtagctgggcaggtgttaagcttcagggggcaaccatccctctcttcaga

SEQ ID NO: 392598 - DNA, 282 bp, Homo sapiens
ttgtttgggaaagtatataaagtggcttccaggaattcacacaattaaaataaggaaataggggctacatggaggaaaatgggggtaaaataaaaatattaggaggagggtttttcaaatgcagatatgtaagccataggatcctacatatgtcctacaatttggctactagcttctggtagccaaaggtaaaagatgttattgctgatttaatttgtgttgtttgtcagggaaaaagcaaacaagttatgtgggaggaattatggttttactgcatgtagt

SEQ ID NO: 392599 - DNA, 432 bp, Homo sapiens
tgggcctccttggaagcagacccaccagccccagttgaaccttcagattagggcagccccagcccacacccatctgcagtctcatgagaggagagaatctaagccagacttcccattcaaaaagatccaaaatttgcaacctacagaaacagagacaatacatgcttattgttatttcaagccactaaattttgaagtaatttgttcctcagtaatggcttctaagtggaggaactgattcctccactaaccccacttggggtttcttgttgcctctccagtgtgccagtgtgaaaaatagcaagataccttgggcttctgactcaaacagtaagaaaaaaattgtaatttcacataacaagaattcaagatgtagagagcatctagggtagattaacaaagcagcccagtgatctcactcaggccccagat

SEQ ID NO: 392600 - DNA, 378 bp, Homo sapiens
  misc_feature (115)..(115): n is a, c, g, or t
  misc_feature (189)..(189): n is a, c, g, or t
aagcaggctaacctggtaacgcgacggcgatccgacccgatacgctgcatctattctcacgcccagatcctgagggctgtgagggtccttagtcactctttttgttaattcacantgcagtacccttggactcagtgcccccagggaaggggtgcccacggcaagggactcaagtcagatggttccccncaaagggattcgagttccccttgagacacaaagttcagctctggccatgaacatcctcagtgacccagtgacccaggggcagaataaacaaccttctgggacaaacccactctaaggaaagagatatgactcctgagttcgagtgcagttttgctgttgaattgctgtgggacctagcaagttactgga

SEQ ID NO: 392601 - DNA, 223 bp, Homo sapiens
ccagtgtatacagagcatgttctgagaaacttatacagaaaacagaagtgacctatacacgctttcatttattttgatgattaatttttaaaaagtggcctttctgaggcaagtctataatctacaccctaaagaagtcttctcaagtgacagggaacttcaaactcagggcaagcaagttttggagaatgactgcctcttcacgattcgggctctggtcttc

SEQ ID NO: 392602 - DNA, 356 bp, Homo sapiens
tgcacatgttctttgtttcttatcccctctttttctgctttctctggttttatttgagtattttctctcctgttttagcatatcagtcatacttcagaatttttttagtgattgttctagagtttgcaatatacatttttaactaaatttagtgtttaaatgacactgtattgcttcatgtgtagtgcaagtccctcagaatattctcagttcatcctttttgtcccttatggcatggctgtcattcatctcacttatctatatgctataatcatccagtgcattattattactttaaacagttgtattttatatcaattaacaataagaaaaataattgatattatgttatcttc

SEQ ID NO: 392603 - DNA, 373 bp, Homo sapiens
ctgcctcagctaatttttgtatttttagtagagacggcgtttcaccatgtgggccaggatggtgtccatctcttgaccttgtgatgtgcccgcctcagcctcctaaagtgctgggattataggcgtgagccaatgcgcccggccatctgatttatggttgataaaatactataatgtattttaaacttagtaagtgttacatatgttaataaaagtaagggaaaaaaacctaactgggtaagtgtgttttattcctgtggctaagaataaaataaaaggacttaacgattattattttcttttggctgcagaaacccttcagtagatcttcttaagttaccttgggtaacaggatataattatacccttggtc

SEQ ID NO: 392604 - DNA, 341 bp, Homo sapiens
tactaaaaggccaaaatggttctctctctcatgagtgggattggaaatatttttttcttatctgtgctttctatagctgtcctgaataaatgtcacaatcagacttggaagaaacactgtccttggcaaagaataattcctactaaggataggcagtttaaggctcaagccctgagctatttctgctgagcccccatgggatcagagaggaaaattcagcaccacagagacctggctcagctcagcaggcagctgggtcctcactatggtccctacctggcccccacctgttggagtggctcagttcagagaaaaacgacacatcctgcgctctcttgtct

SEQ ID NO: 392605 - DNA, 634 bp, Homo sapiens
atggaggaaaaatgatcgattataaagcaaagatggaaaaagaaaagaactcagcaatgatgcagaataatctgtatggcctctaccaatgtctcaaagtgtaaaatatggagaacttgtcatcagaatctcctgagatattagttcaaatgcagaccccctatttcagatctatggaatctgaacctgtaaacgtggggctgcaaaactcatttttaaaaaaatcctgttttgagacttgcagctagagagaaagatttacaattacatttcatctaacaaatccagggaaaaacaattactttgatctgaaataacactcagctttacattcttgataggagcctataatattatacaaactgagtagaagctcacatgttcacatcacattttgtaaaataaacttacttacttcaaagtagaataaatatatccagcctggacagtacagtgagacctcatctctataaaaatgaaaaaaattagttgggcatggtggcacatgcctctagtcccagctactggggaggctgaggcaggaagatcacttgagcctgggatgggaaggctgcagtgagccaagagcacaccactgcattccagcctgagcaacagagtgagaccctgtctc

SEQ ID NO: 392606 - DNA, 487 bp, Homo sapiens
atggaggaaaaatgatcgattataaagcaaagatggaaaaagaaaagaactcagcaatgatgcagaataatctgtatggcctctaccaatgtctcaaagtgtaaaatatggagaacttgtcatcagaatctcctgagatattagttcaaatgcagaccccctatttcagatctatggaatctgaacctgtaaacgtggggctgcaaaactcatttttaaaaaaatcctgttttgagacttgcagctagagagaaagatttacaattacatttcatctaacaaatccagggaaaaacaattactttgatctgaaataacactcagctttacattcttgataggagcctataatattatacaaactgagtagaagctcacatgttcacatcacattttgtaaaataaacttacttacttcaaagtagaataaatatatccagcctggacagtacagtgagacctcatatcgggacctctagacacctcc

SEQ ID NO: 392607 - DNA, 661 bp, Homo sapiens
gctgtgttcgattacccaacggtgccgcttttacttttaataagactttactattttttaaagtaggtaatacgaatacatggtacaaaattaaaaataaacagaaggttaaaaatgttaggaatcctcccatacaaaagtattttaaaactctgaaaactttagctagtttggaagcagagattcaactgaagtctgtgttgaagtgctaaattcaattcacatgaagaccacagctatgctgctaagtccttcaaggcagcaggcaccaagtagaaccaagttagccatcgaatgcagtctttggcatagccaggtcataacacatctctggagtcaactaagataactttctgaagtacagtacaattttgtttatacacatctttttaaatttctagaaaacccagtccatttaattgcttctccagttcttggttttctaagggggagagaacttatcacgagagtattttgggtgcaggcgcacagacatactaacacccatatactacatggtacctcttaatttatggctgtatttacatttttgtttaaaaaataagatcttgaaattttgtcccagagtatatgggaacttccacatatcctaaccacctttactatcagataataaagctgaatacggtcatgtttctca

SEQ ID NO: 392608 - DNA, 331 bp, Homo sapiens
  misc_feature (142)..(142): n is a, c, g, or t
  misc_feature (196)..(196): n is a, c, g, or t
  misc_feature (285)..(285): n is a, c, g, or t
  misc_feature (295)..(295): n is a, c, g, or t
  misc_feature (319)..(319): n is a, c, g, or t
ggttgccagtgatctcctttcttatcacctatagacagcttgcctacaggaaaaaagaaagccaaacacagacaagcagtatgagatacaatgagcgcccttgggccattaaaatatgattgtgtgcccaaggtcgcctggnctgcaaacagctctccagaacctgcagccagcacagaccaaagtcaggtttgtntcctcttctgttgatgaacaaaggttgattccatatcgtggctattgtgaatagtggcagtaaacatggcagtattgtatgaaaatatnacagattagnccctttaaatatgtgcactatggntgatctatcaaa

SEQ ID NO: 392609 - DNA, 465 bp, Homo sapiens
caccccctgcctctctctgggtatcagcaacatcctttcaggcaggctccaaacagcttcctttgactcccaagctctgttttcagtcccaccttgaaatagggataaacagacctggtttctggattctgggaaagggctcttggtggcctagcttagatagttgtccatccctggaccaggaccttggccattttggatgtctacccatacccaatctgagatggagtgggacagggcttgtagaagatgttagctttccctcaaaccataatgtcagagtgagtgaaggagcatttctagaaaagagaggaagagatatttggtaggaaaataaagccccagaggtgagtgggtgagtggaaggagggatgcatgcctcctcaggaccaggtgctgaggtggcagaggggagatggagagaggggagaaggaaagtctcagccttcctggaactcacagtct

SEQ ID NO: 392610 - DNA, 284 bp, Homo sapiens
ggccagctgcgtaaggcacctggtggtgctctaggcactgggttagcgtcccttatgccgagctctaaaccttcagaatgcccttgccgcccctggctgagttcacagtggctgaagctgttcccataagaccctgaatctagcagccactgtgtactatacctggagcagtccaactgggtggactgtgctcagcatccgaacatctagacaggcagaggtttcagtgaccttggactgtgccactgcattccagcctgggcgacggagtgagactctgtctc

SEQ ID NO: 392611 - DNA, 578 bp, Homo sapiens
cctgtaatctcagctactcgggaggctgaggcaggagaatcacttgaacctgggaggtggagggtgcagtgagctgagaacgcgccactgcactccagcctgggtgacagagagagactccttctcaaagagaaaaaaaaatcactcaggaacgggccttatctaccacccagttttcactggagggtcactatgtgactgaagcccttcctgggaaagggaggagacacagcagaagattcaagtggggactgtctacaacataaccaggtgggatcttcaaacatggtaactgagcagaactagtgtgatagcgagcccagccaccagaaatccctacttttgtgaaagttttatcctgccttagctattgagcaggacacttcttgggtcagtgcgaagatgcgactctaaggaggaaatgagtccagggggaaatagacacagacatgggcacattccctctgcccacaactgggacagatcctcctcctcaccttcagtatctctctgctcctactctggggtgcagggaaaagccatcacagcagtggaaaggctgggttttatttgaggtt

SEQ ID NO: 392612 - DNA, 356 bp, Homo sapiens
ggatgcatacccttcctgaaatgactcccttctgaatgaatgacaaagcaggttacctagtatagttttcccaaacttcttcccatcatagcacatgtagaaaataatatttttatggcacactgggataaacaagcaagattgctcacttctggaagctgcatatgactagaggcctcttgtgactggaggtaacaaccctgcccagtaactgtgggagaaggggatcaatattttgcacacctgtaataggccatggcacaccagccaagatgctctgctcacagtcagtatgtgtgaagatccctggtgcgtggccttcaccacgcatcttgagcaaattaggaaaatgtacc

SEQ ID NO: 392613 - DNA, 535 bp, Homo sapiens
gggttgattagaacagttttactcttgaattcagggtagttttttgtaagagtgaactacattttcgttaaagatgaaacaattctggatgaatatttcaagatttttctatagaaatagtattgaaaggaagatagaataatgttcaagcaaaaaccttcctcagggtgcttttttttttttttaaacaaccatattgaggtataattgaaatccaatgaattgcacgtacctagagtatacagttggatcagttttgacatacacagttgtgaaactatcaccacagtgccatcactctcccagtttttttggtacctgtttgcaacacatccctttcgttatccttatctctaggaaattattggcctgctttctgtcactatcaattagcctaccttttagacaattttataaaatggagtcatgtaatatgtacttttttctacccactttcagcatgattatttgagatttattcatattattgcatatatttattccttttttattttatcatttgtttatccattca

SEQ ID NO: 392614 - DNA, 310 bp, Homo sapiens
gaggaatggtattttattctagcatgggcatcgaagaaggtgtctctaagaatgggcatctctaagacatctctgaggatggcatctctaaggatagtatctctaaggatggcatctctatggatgggcatgtctaaggatggatgtctctaaggatggcatctctatggatgggcatgtctaaggatggatatctctaaggatggcatctctatggatgggcatgtctaaggatggatatctctaaggatcgggctactttcgctacatcacagtgaggagattgtcccaccatcgagctcctctgaca

SEQ ID NO: 392615 - DNA, 424 bp, Homo sapiens
cctataagagactgagaatgctatccttatcaaaattccagtggcatttttcacagaaataggaaaactatcctaacatgtatatggaaccacaaacaccctgaatagccaaagcaacgttgagcaaaaagaacaaagctgggaccaggcgtggtggctcatgcctgtaatcctagcactttaggaggccaaggtgggaagatcacctgaggtcaggagttcaagaccagcctggccaatatggcacaaccccatctctactaaaaatacaaaaattagccaggcacagtgacaggcacctgtaatcccagctactcaggaggctaaggcaggagaataacttgaacctgggatatggagcttgtggtgagccaagatcatgccactgcactgtagcctgggcaacagagtgagactccatctc

SEQ ID NO: 392616 - DNA, 230 bp, Homo sapiens
gcggccgcctactactactactactgctcgaattcaagcttctaacgatgtacggggtcatgcctgacctgatgaaaacacccttaaaaaatcaaccatccagtagtccaaagccaatttcaaaactgctttatttgcataagcaatatttagaaccctggataccaaagatccacatcattgccagtggagaatggcttttttgccctctatgctggaacaataaaaaa

SEQ ID NO: 392617 - DNA, 488 bp, Homo sapiens
caaacagacaaaacactgaaaaacatgtcactgaaatggagaaggaaaatgccagctctgtcgagcttgtatgagaagaaaagggaggtccaggctttgccacaggattaggaataaaagcagatgaaaggtgggactctatccaggaacaggccgtattgaaagggaattttatcaaaattgcagtaaacagttgccctctcttcagccttggaaagaaaaaagagagagagagattggagtgttacctacaagggtgagagttgatttttcttttaacttttcagctaatctgtcaccttctatgtaataaagggctgaaaaataaaaatctatcaaacacctgattgagagaggagtctgataaacgaagctgaactcactgctcctcagaaaactgcaaatgaacacaaccagaagccatttcttacccatcagattggaaaagaaaatggtagtgggtgagagtgtggagaattctcacgccc

SEQ ID NO: 392618 - DNA, 398 bp, Homo sapiens
tatctccagggtgttggcctcttgtgctaatttaagaagagtgaagttttttggaaatttgagaaaatggaaattcatttcttatttatttattcaatagaaacggggtttcaccatgttggccaggcccctgagaagggaaattgtcttgccatcgctaaaacaagattggttcttgaagagagtaatttttcccttctatagccttcactttttatgccacttgcagattttcttggactgtatttgttcttctgcctcttggtcaggaagtttgagtttatgatttggtttcccttaagctaggtgcagacatgagccctgaactggaggcagagataaagggtttgtaatttacttatgttcgtagggtaaggtgtgtggagtagagagcattc

SEQ ID NO: 392619 - DNA, 502 bp, Homo sapiens
cgtttataaaaattgtggctgtactaaacatacacggtgctgtggtgactgaaagcagatgagatgcagcctattttgtgtgtaccttgcagatatgcagcctccaatgatgatgtgttatggggaggtcacaaaatatacgtgaaatctacaaggccgagcagcccttggctgatacctattgatcatatttttccctctgcagtttatcgtattcatgattcaaaggaacaaaccaagctggccaagagagtcttccaaagttagtaaaaaagattcaatctgtgagacataagtttgcctccctctttttatgtatattaatgccatactgccgaagcacctggctgttgaaatgaaagtgagccagcatatggatttaacagatttggaatcctcccaaacaagcattttcttaccaagtcaataagagtaaatgcaggtaccaaagggaacctagaataaagacatctaggataaaacaatacttaattcttgagaa

SEQ ID NO: 392620 - DNA, 237 bp, Homo sapiens
ttatatgagggcagtgatctgggaagtatccaaaagcagaggtatcaactatcaagaaaaaatgatgaaatatacttatttggggggctttatagaaaggaggaattctgtgctacacctattatatatctaactcaaaagtcacttattcagttccttttatatgcaatggactatgcttctaacagacttttcagccacatgcaacaaaaaaccaagtaggaaggaccaaggaga

SEQ ID NO: 392621 - DNA, 598 bp, Homo sapiens
tcaaaatccatgcatactcaagtcctgcagccagccctgtgaaacagacatatacaaagaaggctccacaccaacctatattatatgtgagtatcaaaattcatattttcaatctgcctttagttgaaaaaaatgtatattaagtggacctgtgagtcaggcatggtggcacatgcctgtagtcctagctaccaggaaggctgagatgggagaattattggagctcagggttttaacaccagcccgggcaacatggtgagacacccatctcaaaaatattttttaattaaaaaatattaacaactggtggggcgcagtggctcatgcctgtaatcccagcactttgggaggccaagacaggtagatcacgaagtcaggagttcaagaccagaccagcctgaccaagatggtgaaatcccatctctactaaaaaatacaaaaaaaattagccgggcgtggcagcatgcacctgtagtcccagctactcaggaggctgaggcagaagaatcacttaaaccagggaggcggagactgcagtgagccaagatggcgccactgcactccagcctgggcgacagagcaaaactccgtctcaaaa

SEQ ID NO: 392622 - DNA, 614 bp, Homo sapiens
gttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattag

SEQ ID NO: 392623 - DNA, 116 bp, Homo sapiens
aaattatctgtcttttgaggactgacataattcttttgtggactgagcctaggttgattcttttaaagaggtaattcaaagacaactttcctgttcttccccgtggcattttctct

SEQ ID NO: 392624 - DNA, 136 bp, Homo sapiens
tctgatcgtcatctccaagacctaatgatttgatgacctgtggagccattcaaattcacttgctttgggttgcaagtgagtcctttctcacggttaaccttgccttgcaattcctgggttatggagcctggcaggg

SEQ ID NO: 392625 - DNA, 827 bp, Homo sapiens
gccatccttggccctaggtggactttgacacaaaatgaaagttgagggaaaggattgaggggtggaggggcaggtttaacgtggctggtagcttactagctgttccccagagagggccccatgtccccgctgtgcccatggtgcggcagttcacctgcctctccagatggccctttggacagcccattccagagttcagaaggtggcagcagatggagctaaggcgcatctgggattgcagggtttcggctattctagagaagatggtaatgccctgcccctcccttctacccccttcttggaagagggtcttcctccttaatgaagctaattgacaatgtgcattttttcctggaagcttttgagaattgccaaggctggtaaatataatcctgctattagggggggaaatggcccgtaggaatgcttagatcaggagcctggatgcagcagagcaggagatttgtgagtttttcagcaatgtctgcctgcttcccagacccaactcaaaacaagaaaggatttgttcgtgtaattagaaaaggggtctgattacggggagggatttttgcctggggtcatatgccttacgctggcccattagggttggcaattctaggtggtctggagaaatcagaccccatgccaccctccctggttcaggcaggagaggagttgcagaggtaaatatgaatagatgcctcttttgaggatagacagacttaaaagaaacttttcgagaaacatcagggaaattttatgccccaattttttaaaacagaattatttcggtgactttgcaaaagcccttcaaaaaaatctgacag

SEQ ID NO: 392626 - DNA, 750 bp, Homo sapiens
catatgttcatataatattttctatacttagagaatgctcattgcaaattcaacaaaaaaattattaaaaacccttcagtgaatgataaaacacagcctataaacctgctcctggtgttatgattttatatcaccttaggaaatgctgaagcaaatgtaaaatcagtatgttcagctcagtttttattttatttattaatttattttgagatggagtctcactctgttgcccaggctggagtgcagtggcacaacctttgctcacagcaacctctgcttcccagattcaagcgattctcccaccttagcctcctgagtagctaggactacaggcatgtgccaccatgcccggttaatttttgtatttttagtagagacagggtttcaccatgttggccaggctggtctccaactcctgacctcaggtggtccacccgcctcagtctcccaaagtgctgggattataggcaagagccaccacgcccggccctcagctcagtttttttgttttcttttctccccccgcccagcatgatcttggcttgctgcaacctccgccccatccccctggctgaagcgattctcctgcctcagcctccagagtagctgggattacaggcgcccaccaccacgcccggctaatttttgtatttttagtagagacgggtctcaccatgttggccaggctggtctcgaactcctgacctcaggcgatccacccgcctcagcctcccaaagtgctaggattac

SEQ ID NO: 392627 - DNA, 287 bp, Homo sapiens
ttctttgggaagagaagaaggggaatgttgggagtgtttgctgaggctgtcggaggaagcgaggctagagctgatccagtcccatggtgtggtggggacaagatggaggagagtgttcagcgcagggaagagagtctgtacaaaggcattctgttttatgtttttaagtgaaatgtgtttgttttactttcttaaaataataagctatctaggcttcatatgtgttaatgtatttagtctgaataaaacaacttttaatcatctgatatgatctcatagttgaacta

SEQ ID NO: 392628 - DNA, 259 bp, Homo sapiens
gcagattacatagtggaggaaacaaaaatctgggtgcgctttgcttgccctcactgttctcacaataggtgctccccggctggccaacgcgttatccatatggctttgtctccaaggctccaaaaattttctgacagcaaatagtatattatgtccactcaaactttggtttataatgggtttattattccatatcacatagtaatttttttttttatttttggccgggtgcggtggctcacacctgtaaatcccagca

SEQ ID NO: 392629 - DNA, 500 bp, Homo sapiens
caaggtcacttttcccatctgaggaaacgtttgtcgtgtgctccgaccgaagcgttggcactgacccgtctagaattctgtgtgcggagtggaggtgagatgctgaggctgtgcctcagcctatcttgggtccccctctgcctacaggcagtgagtgtggcctgggaggcaggtggccctgtggggtgactgagctgggcgttgtcctttcctcttcctggtgtgtgtagcgagcctggtcagagcatggcgtctggagtcaggcggcctggctacgggtcttgggtctgccactcaccagcctggtgtgggcagccattttagcctttctgggcctcagcgtcctcctctgtggatgggggacagtgcctgagcgccgggggctgcacatggtgcctgtctctctgcgttcttagtggaggtggcccctgtggtggtccctgttgatgccgacctgctagcctgctccatgctgtccaggagagtactggggccttgcc

SEQ ID NO: 392630 - DNA, 737 bp, Homo sapiens
ggatctccacatttaagcagtgggtaagggagtcaggtataacgctttaattgaaagtcaggatctttaagaagttataatatctgatgtggaaaaaaaactgcagccaactttattgaagtaaggttgtttaggatgcttgctgtttattaataattcaaccttattttctatcaaacagtatgattttgtttagtatttgtgattttttaattttattttattgtatactaacaaaatataaaaattcaggccagtgcagtggctcgcttatgcttgtaaaccccagcactttgggaggctgaggtgggagaatcacttgaggccaagagttcaagaccagcctggccagcatagcaaggacccatctctacaaaaagtactaaaaataaaaataaaaatattagctaggcatggtggcatgagcctttagtaaaggcccagctactcaggaggctgaggtgagaggatcgcttgagcccaggagttcaagactgaagtgagccatgatcaccactgcattccagcctgggttgacagaggaacaccttgtctcaaaaaaaaaaaacacaacccatacaaaaaaaaaacattttttggggccgcttggggccctggaaaaagttttcttaaacacattcgcttttggggccggggccccctggtgttcggccaaccggggccacaggtggtcccaagggaagacccgggcggacaaaggggtttggtttttccca

SEQ ID NO: 392631 - DNA, 500 bp, Homo sapiens
gtacgcatctaacgtgtatttacgtgtatactgagttagggtgtacaacttttccctgaggctgtatctcaaaaactttggaagctgaagaatttgtccaaatctatgttcctttttgtttgtaaatcacctgatgatggtgatatagctgtggccaacgaaatgtcaagggaagtctgctggggaaggtagacgtaggataggagtatgggaaaaaattattcactcaaaagcatgatgcacagaggagctatgatcttttcttgttttcctcactggatgttgtcatgtctgtatgtacttcctggaactgtggcaccatcttacaaccatgaaaggagctcacatgaaatcatgttgaacatagcagagcgggaagatggaaggaatccgagatctatgtttgatgttaagcgatgatgttaaaaacttaaaaaactccagaactctcttacccctgggcttgttataataaaaagataataatcctcttagtgttt

SEQ ID NO: 392632 - DNA, 353 bp, Homo sapiens
aaataaaagacttatatacagggtactcctaggtagcagcaggacagctctagagatcctcgccacctcccatcgctaagctgcttttaagctaattttctggctctttgcctactatgtgtgtgcacgatgggactgttttccttggtagtttctcagatcttctctgggatgttggggttctcagggacacctgttccttggctgggcaccatggccttggctcactgcctagccttcagggtttaggcagcagacatacacccttaagtaaggtaggtgacctgtcacatttcaccccatgtcaaagaggaaacgagtcagataatttgtggttgtcctaagattttggt

SEQ ID NO: 392633 - DNA, 571 bp, Homo sapiens
gcatcaacgatggcaatagaaactccaccatgaccaagtggaatttagcccaaaaatgcaagaatggttcagtatacacaagtcaataaatgtcatacatcacatccatagaataaaggatgaaaaccatatgatcatctcaataggtatagaaaaagcttttgataaaatttgacattgttcatgataaaactcttaataattaggtatagaaggttaatacctaaatatataaaggccacatatgacaaacccacagctaacatcttactgaatgagggtgaaagctttttctgtcagaagtggaacaagacaagagtgtctactcttaccacttctattcagcatactactagaagttctaaggagagcaattaggcaagaaaaaaaaaaaggcatccaaattggaaacaagtcaaattgtccctgtttgcagatgacataatcttatatgtagaaaaaccagaagcatatattcaggggaagttgaatctgtgctctcaggaaataaaatgttattattaaaaaaagacataagaaaaatctaaagactgtaccaaattactcttat

SEQ ID NO: 392634 - DNA, 481 bp, Homo sapiens
atgcaatattttttgtgctgtgttgttagagatacacaaatgtaatatttgagaatgtgacataacaaaatatttcttaactgtgatattgatgaaaggttgaataaagaggacatctggaaaacactgaagaaactttagttctagacagtagtttgaggagacctttgactctaataatagccagtggtaggatagaggacaaggtagatgtcaaaaaccaacagggcttggtaacagagggattttaattagatttgtttatttaagatggtaattgaagaaattgagtcaatgacagaaatagagtaatgccaaacacaaggatttgaataacagctaatatattaagaatgtctatgtccttatttattttcaagtgaaaacaggaaatccaggtaaaattttcccatggccagttggaagcattcaaggttgaattagaaatcagggtttgagctaggtgcagtggcttacacct

SEQ ID NO: 392635 - DNA, 746 bp, Homo sapiens
acccacgcgtcgctttgctcctcctttggcttccgcgatgattgtgaggcctccccagccatgtggaactcacttctccttcctgtcaccatgtgaagaaggacgtgtttgcttccccttctgctatgattgtaagcttcctgaggcctccccagccctgcagaactaaatccaaagaagccactatgctgaaaatactttgagtgggttagagtttcgctcaaggaagtgctgtagtagaaaatggccatttctctgtgctgtgttcagagtaagagacatgggtgaaagagttatccggaatggaatgctgaggagaccctaaagggaatttccgggtggatggccagcactgtcactcgatgagtggaggattgacaaacttgccaaatactgcaagaaaagatgttgctgatcacggataggaaatactccaagtcccaggagatagtctgttcttaggagacttccacaccaagtctgctgaccagagaaggaccagtcaaccaccacactctccgctggagcccactcagcaccagaaggaaacagatggaaaaacctagacttgctcccttagatcagtgctattatcaatatcatcctctgagagacaaagctgttaaattactttgcccagatgacatggccagtgagtatggagacagaccggaaattaaggctctgttctagattctcggaatatagcagtgaacaaaacagataaaacgtgcctgcccctgtgg

SEQ ID NO: 392636 - DNA, 255 bp, Homo sapiens
tataacttgtaaacaaatcatagttacatctacaattggcaaactatgtttttcagcataccattatttttttctcctgctctcctctacttacttccttctctatcccatggggttagaaattactttgaacagattggtgaataagggtaatattccacaagctacagcatccactctttttatggtttggattttttttctctatctctgtatctctatatacttctgaaatctgtaattcttgtgtgtttt

SEQ ID NO: 392637 - DNA, 598 bp, Homo sapiens
ctagagcatacccctagggaatggtggtgaggaatcatcagcaggggggtggaactgaagcatttaatcagggcagtgctgagcagagaggagggctgaggaatggcctgtggggcattagaaagtactaggtgttgtgaagtaaagggaaaatactggtagctcccatttagcttagagtgtcacccataagggaaatccttgtttgacccactgtgttagtttcccagagctgccataacaaatcaccacaaactgggtggcttaaaacaaacagaagtttattcttgcacagttctgcaggatagaagtttgaaatcaaggtgtcaccaaggctgtgctctctgaagaatctaggggagaatctctcccatgctggtttaggataaggaatatcttatcttggttcccagtttctggcacaaagcttcaaacatctttggaatatcttcagtgataggagtgtctttattatgctaatatggtgactcataatggggcgatagaaagcttgaggatgagggctggtcaccagaaaggacaaccatgtgacaaatgggttagaactttgagtcaccccaacttctggggaggggtc

SEQ ID NO: 392638 - DNA, 492 bp, Homo sapiens
gatcctggctgtattatcagctattagataacacaattttaaagtgcctgttgccctctggacaccgaagactcaacatttattgcttgagcattgcctttgttttgaatatggctttgtaaagacaaaaatccaggctgggtgctgtggcttatgcctgtaatcccagcactttgggaggctggagtgggcggatcacttgaggtcaggagtttgagactagcctggccaaatggtgagacccccttctctattaaaaatacaaaaaattagccaggtgtagtggcacactcctgtagtcccagctactcaggaggctgagtcagcagaattgcttgaacccaggaggcagaggctgcagtgagccgaggtcgtgccattacactccagcctaggcagcaagagcaaaactccatctcaaaaaaaaaaaagacaaaaatctgagctcttcttttagaacagaggagagtaatactctaagttatgatcatt

SEQ ID NO: 392639 - DNA, 387 bp, Homo sapiens
atgacttatcagcaacaactgatccaaatgaaaactgagtgatatagtcaaagtatccatccaaaatgttattatttgccatagtatcaattaggagaaagaacaaaataagaacgtttaaaatgttcaaaccctgagtctattacacacagactttcattaaaaggcctataaaagggtgtatttaaacataagtgtgagatatgaaatagacgaaacaataatgaaacacacaggaattcataaaatatgttggtaaatttaattaaacatctccctttaaaatctgatattttcgtgttaaagggcaaactaaaattctaaataataataacaaaaaatagcataagtatctcaatgcctaaagtccttatccatggttggggg

SEQ ID NO: 392640 - DNA, 221 bp, Homo sapiens
gtgcctgtagtcctagctactggggatgctgaggtgggaggatcttaagcctaggagttcgaggctgcagtgtgctaacaaggtgccactgcactcctgcctgggcaacagagtgagatcccatctcttaaaagaaagacagaaaaggtaaaagtctatgtctactttacttgttgccttaaaaaatatgaatcccaggaagagggctcaatgtgaaacac

SEQ ID NO: 392641 - DNA, 563 bp, Homo sapiens
ggatggcttacacaacaaaaattggtttctcacagttctggaggtgggaagtctaagatcaagatgccagtcgggttggtgtttggtgaagactctcctcttgggttgcctacatcctcttccttgctgtgttgtcatgtagcagagagagaaagagagcatgagtgagctctctcgtgtctcttcttacaatgacgttactcctattggattagggacccactcttaggaccgcatttaaccttaattacttccttagaggctccctctccaaatactaatgatagggcttcaacataagaattttgggtgtatgcaaacatttggtccattacagtcatcaacaacaaaaacagaatacctctattttacgtataaggaagtttaaaatcttttgtttaatgagaaagtgggcaagaaaagtttagcaactagttttgcttaatcatcagctacagaaactaatttaattatctagttataataaattcacacagggatttttgtttgtttttgagacagttctcactctgtcacccagactggagtgcagtggtatgatc

SEQ ID NO: 392642 - DNA, 253 bp, Homo sapiens
gtgtaagagcagaggaaagacagtttgagtgtttttcctacacaccagccaagtgattgttagcttggaggttagaataaaagttctttaagcacgaaaggtctcaagaaattgaggccaggcacggtggctcatgtctgtaatcccagcacttagggaggctgaggcaggcggatcgcctgagtccaggagtttgagacaagcctgggcaaggtggcaaaactctgactccactgaggagactgaggtgaaa

SEQ ID NO: 392643 - DNA, 101 bp, Homo sapiens
caattcagaggagtctcctgtgcttccaagaagtcctagtgaaactgagctctactgtctatggcagtggcctcatttgagtgccctgatattggctttct

SEQ ID NO: 392644 - DNA, 576 bp, Homo sapiens
gtgactggtctaagagaaaccaatggattcgtattgatgtcagggtgatgttgatggggaatggagttggtgtgactagggccatggtttctgttcatgggctaccctctgaggggatggacaagcgaggagcaggtaaagccacagaatagccaacagtagattgcctggcactgaggtctgcatgtgtgggcccagtttgtcagtttatcataaaatcccatacacttcaagatttgccctctttctggcatcctcagtatctgacatgtttcaaatcttaaaaaaaaggttagttgaggaagctagctttaggttagaacatttgacagattagcaaatggagccccaagtcgaagaactgccatctgataagaaggagataacagcagcaaaaggatcattctgagtcactctggccgttcttttgaggcccaggaatcctgccagcttctagggcccttggagtgtcactcggccacgggaggtgtcattacagatgttcataatgaccttgagcatccatgaaaagctgttacttgaggctccttagtttttcagtcacagccagagtaa

SEQ ID NO: 392645 - DNA, 525 bp, Homo sapiens
  misc_feature (314)..(314): n is a, c, g, or t
cacaaatgtgttatttagaaatatggagacaaacagagaagaaacagctgtgagatttgaaacagactgtctctagacaggagtcagaggccaaagaaaagtgaggcaggagaatgctgttttgtttttaaggacacacctcgcaaaaatattcaacttttaaaactacgtaccggacaaatggagcaacagagaccaggttcaccctaacacctaacataaccccctccccccaccagaaagggagaaaatacgtgagacgcatggttttcaatgaggggtagcgcctgctgtgcacaggaaagcgagcgagntgggtctgcaccagctcggtgcctcaagggcttagggggcctgccagaacccgaggtgcagaaatgggggccgagagtctggggagatcgccgtctagctggccggacagagtagcagagaagagagggctgtacacagagaactccagaaatgggtggcaggtttcctgggtagtcagcagagtcctggttggcccgtgtgtgtgtgtgg

SEQ ID NO: 392646 - DNA, 2449 bp, Homo sapiens
ttaatgttggttaaaacatgccaaattgcttttgcttttagatattagtcttttgaaaaagttctactttcctgaaaattcaaagtgagggtctaatgtacaataaggtaaagacccccctattgtttcttatgttttttttatgaaatataatggtgtgttttttcttgtctgtgcttttgatttgtgtgttttagagcatctgaaaagtcaactatataaacataatagtgaaagagaaatttcactatcaaaagatttgcacaccataagaaaaacattagttacatagctactgaactaggttagtacactggtttttgctttggtctttctatgcctggccattttaccagataattatttcagtgaatttgaatttagtgtatttgtcacttaaggaagcttataggcttgggccatatacttcttttttggatatgttaaagaaaaaaaatgttttaggcttgttgtacccctgaagttggagcattgagaactttgtttatatttgtatattaaaattgttcccacccccaaattattaaattggtgattaccttttttccctctccaggaagtatttatccatgtagataatacgttttgaagggctttggatatcaggggctgtgtatgaatccctatcttgtcaaagaaattatttttttaaaactttattttgaatttttataattctagttattcagctgaaactgagggattctattgccagcttttatgtaattggaaagatttaaatcagcttgtgttttaaaaagtaatgttgctactgtaagcagatgtactgtaagttagtgattatgtttgaccaccccctccaattacatgggtatagctatttaaaagaaaaaaacaaaaacaagcaaaaaaacttactaatacaataaatgtccatgtaacaaaggtatctgttgcagtgttcattttgatttacattattgcacacacactgggctagatttcttttttaaagactctggtcttccaccccaaattctgggcctttgctcatttggggtattgatactgaacatatacagccaattaatgtattcaaatggagccctaagatccactttgcagtactagatgtgtagatttacctatctttagcctaatacctttcttcatttatcatgtattcttagtcgcaggagctgctcagctcctgatttctgttattactgcccaggcatcctcccttcataagacatgcctatgaaatggacacaaaaatttggaacacaacaaatctaagacttatcataatagttttttgttttattgttaagattttgtcatgtcctgtcatcttttcataggtaagtttcagatcagattcttgttcagctcttaactgctgtgttgtgctttagtgcctgtataaatggcagtaaataggttctacacagcttgcttagaaatcggatataaatgactttttagatgtctctatgattgaacagcaatctagatatgtgcttctctacctttctttaggttgtaaagaaagcagcctaatagatgcttagggaaggaattctggtcagttgtgggaaataatcaccactgggccagcattctgcattatagactaacatagcttcagcttgaaatctgatattttaatacacctctgattggaattagcaattacctgtgttattttctttttgtgacccccagtttcccatagttttagtggtggtatgactggcaacattgttaacaacaaatagacccatgccagactgaaaataacttgaaggatttcataaattttctttttgcatactattcatggaaataatctactctgcacttccctatgaatggatcatgatgcaaggctgtccaaaaaaaaagaaaaatatttctttatgaatcaagtctcaaggctgatagtataaaagacttatggaaatggaatttgcatatttttaaagtaattttactgagctcacatatcaagaatatgaaatcatgagatagagataagttctctcaattctcattagaattggttggaattaattccagattattttcctgggagattttattttaagatgtgaatgttacaaccattacagttacctgtaaggcttgagatctgcatccccaaagtatgttcctttgttagtgttagttatttgagattcacagaaaatgcccagtagcaacagtctgtgctgtctttcaaaaaaaaaaaaaaaagttttcattttttaagataggcttataaccaacacatgtatttttagcaggatgactagtaatcacttttgggttgaagtataagaatttcagtgcatagttttggggtgttaatttttttataaaaatctaaaacacttgttcaaatttgcagctctgttgcttattctaatatattaaagttagatgcatgaaaaaattttattct

SEQ ID NO: 392647 - DNA, 790 bp, Homo sapiens
gtaaggggtgccacctaaaagccaaacaataaaacaccaggactaacaaacgctcagtgcattgctgaacacttggcatgatagaacactgttagaaaacctttcagatcctatagccttgaagcactggttttttcaagaaaattcagtgtcatcatctccttgacttcagagaccagctcaaaccttaagtttaattaggactccaggttggtcaagtccaagtaccatcacaaaaattctacatctttagaaataagcgttcaagtgtttttcaatgtgtatgactactggatcaacacagacaaaatgaactagaaaagcaaggagaaattctgaatcattaaaacccagagagtctttttcaccaggtatgttcaaatagctaaagcaaaaatcaaagttgtggcctctctgcttttaagggagtacaggactccattaagccactgggggatgatccattgtgatcatccatggagggagaactaggatgaaaaaggagacggggcaggaagacacactttactattacatcctgatcacagataaattcatgaaacatttcacactttcaaagccaaggccaggtcaagttaagttccctctctgaagccttcccacactattccaggactcctttctctttactcaagactcaaattacaattttaaatcagcagcacactgtttatccctaagtgtgtaagtctcatctccccagatgaaccatccagatgtcagggttatggctcatccttctcttagggacctcaccggatagcccagg

SEQ ID NO: 392648 - DNA, 360 bp, Homo sapiens
tgaaggcattcaagccttaatagctagctggatgaatgtttaacttctaggccaggcactactctgtcccaacaataagccctgtacattgggaaaggtgccgagacatgaactttggtcttctctgcaatccatctggagcattcactgacaacatcgactttgaagttgcactgacctggccagccctgccacttaccaggttggctctgtatggctaagcgttttctcctaaaatcccttgaaaactgtgagaagaccataagaagatcatatctttaattctatttcacaagtcacacaatattccaatcaaatacagatggttgagaaaagtcatccatcttccctccccaccct

SEQ ID NO: 392649 - DNA, 202 bp, Homo sapiens
tacatatggcccaaagacatgttgaaacatatactgaatatactctacaaaattttaaatatatatgtgaaaaattctcgtgaatatgtgacatataaggtaaaatgaaaattgcctttttgtaatattaatctggtaagaagtggacattaggaaatagttcattcgtttttttgatgcatatgctaataagcctttaggg

SEQ ID NO: 392650 - DNA, 360 bp, Homo sapiens
ccaggagatggaggctgcggtgagccaagatcgcaccattgcactccagcctgggcgacagagtgagattctgtctcaaggaaaaggaaaaaaaaaaaaaagatggtgtcatgctgaattagagaaggtcctaaatccaatgatttgtgtccttctaacaagagggaaggacacacagacacacacacagaaagagaagaaggccatttgaagatgggggcagagactggagtgatgaagttgcaagccaaggaacaccaaggatggccagaagccaccagaagctagaagagcctggaaggattctctccagaggcttggagggagtatggccccgacaacatcttgagtttggacttc

SEQ ID NO: 392651 - DNA, 337 bp, Homo sapiens
aaggaatgaagtactgatacatactacaacatggatgaatgtttaaaacattaagttaatcccttcagggtaaaggcgatggggaacccaaaacattatctaagagaaagaagcagttacaaaagaccacatattatacaattccatttacaggaaatgtccagaacacaaaaacctacagaaacagaaaggcgattactggtgctcagggttgaggtggaagaatgaaagaattggtgaaatgataaagggtaaggtatacttctgcggtgtggaaaatgttctaaaattgattgtggtgatgattgcacaacttggtgaatatactaaaaaccat

SEQ ID NO: 392652 - DNA, 303 bp, Homo sapiens
gagaaccgacagtgtcttagtcggccagggctgcccaacagcgtatcacagacccaggagctggaacagcaggagctgattttatcagtctagaggctggaagtctgagatcaaggtgctggcgggcttggttcctcctgagggtcatgagggaaaaggggtcagtccccaggcctctctttggcttgcaggtggctgtcttgtctctgagtcttcacatcgtcttccctctgtacctgtcagtggccacagttgttctgcttataaggatccggtcacactggattcagcccaccctcatga

SEQ ID NO: 392653 - DNA, 127 bp, Homo sapiens
tggatgtgtttgccttgcttggaggaggcgaccctgtgcccgtccaggcacacaggcgaggggaggggctggcttgctaccgaggagcgggcaggtggtggccatctccacccatgggggctgctca

SEQ ID NO: 392654 - DNA, 441 bp, Homo sapiens
aggagcctcctggctggggcggcaacaatagtcagttccagatttggatctttatgctgagtgtaagcaggagtcacggaagggtttaagcaggagagtgctatgaggcagtctattttggaaagatccctctgactggggcagagtggatgcgggaggctgggctgtggttgatcacagaggtgggaggagattcgaggctggagactccagtaaatgacaggctgtggtgatggattagctatgggtggcggcttgggagggagagggaggtgccaaggatgagtccaaggttcttgactcttaaaactgccagtgcaccccacagtggaaacattgggagaacactgagtttgcttgtagttggaagttggctgaagtgtatctgatgttcttgaaagaccatattgatgtttcagtgtcaaagagagtgcagaaggc

SEQ ID NO: 392655 - DNA, 434 bp, Homo sapiens
tgcaagaaaaaattgaaagtgtgaacagctgttggtacattgcatttgcatttctgaaatttcaagtgaagataaaacattaacagctgtgatagattcctgcagttgacctagtgcctcaggatgtgcaatacattgatgttgtcaggctgtcagggtcctggtgagaactgtagagagagggagaatctgagagggaaaacatgtttgttattcttttaaatatttttttttaattaaatctagagagtcctactgcaatctagcaatcctctattgtcactaaaagagtctttgatttaggaattccagtggttgattgtccttagaccatgcatgtcttaaaaataatgaagtagttaacttcctcatggattgctcatctttttattttgtattttctgagttgtatgtcgttaagagacttcaattct

SEQ ID NO: 392656 - DNA, 222 bp, Homo sapiens
ttcgtgagcagctactgtggaggggcttaggatacgcaggggacaatcctgtccttgcccacgtgatcttgcagtgtggtctgctctgacagtcagctgaagtgtgagctgcatcttcatgtgcctgtttcccctactggcctgtgagcctcccgagaacagggatggtgacctgtccacagaggccaccactgtatccccagcaccagcccagcatccggg

SEQ ID NO: 392657 - DNA, 153 bp, Homo sapiens
ctgatttaaactacaaccaggagactctgtcagattaacactacaatctgaagaactacagagactctcaaaaaactagtgtatagtctacagtagatattaacctttgtttttcttctgttttcatagaaacaccttttattaaaaatctgt

SEQ ID NO: 392658 - DNA, 637 bp, Homo sapiens
tcaaggtaagagctctcaaaaaacaacattggcctcaaatattcacccaaaacctagctgtatgattactgcttgaccaagtgcctttgacaaaatctatctaaaaaaaatcagaccttacctcccttttccagtggagccttttaaggtattcacagctttcattctaatttattgtgaccccatatatctacaagtgtaattggactcttaaagtttttagaccaatccaccactagtagcatagtagaatgtatcatgcggtaccgtgaaaaataatgggaactgaaataagaaagacattcatttatatcctgtctaaatcaattactctcttggagacttggttttctttaatggggattaaaatgctttccattcaagatgtactgagtttaaaataagcatcatacaaataatatcttggtgtatggtaggtttccataaattttatctagcttccttcaaataacattatacaaataacatactacattcctactagatttccatcagttttagttgaatcctttcaatctccttcttttcatttatcaatcataacaatgtgttagacaacagaaattttttttagttacaaaatactttcttcaaacagaacaggactgtgtttttt

SEQ ID NO: 392659 - DNA, 402 bp, Homo sapiens
agagctggaatagactttagggataattgcttccaacgtctcacgtatagtttattgttattgtaaagtactttatagtactttatcaaactgaggtacagcttacatctaatctgtaaaaggatttgctcaaacagatgattttcatgattctagttttttgtggttttttttttttttggttttttgttgtttgttttttgtggttttttgtggtttttttttttgagacggagtctcactctgttgccaggctggagtgcaatgggcgatcttcactcactgcaacctccgcctcccgggttcaagcgatgctcctgcctcagcctcccgaatagctacaggcgtgcgccaccacgccctgctaattttttgtatttttagtagagattgggtttcacc

SEQ ID NO: 392660 - DNA, 489 bp, Homo sapiens
gtatctcagctctgtaacttagtaattacctagacaagacaattcttagggctctcagtctcagctctgtcatctgtacaaagtaaattttactgggatctacctcactgggtttataagtgacgagctcagagttttgattacaggtgtttattcatttacctaacacaatattaactgagcacctactatggaccaagtcctgatctaagcactgaggacatagaaacaatcaaaacagacagaaggccttgtccccatagagctcacattagagtctgtggtatggtagcaggtaatacaagctaaaagaaaataacagagctgtgggtagtgattttaaaaacaggccaggtgtggtggctcatgtctataatcccaacaccttgggaagccgatgcgggtggatcatgaggtcaggagttcgagaccagcctgaccaacatggtgaaactctgtctctactgaaaaaaaaaaaatacaaaaatt

SEQ ID NO: 392661 - DNA, 312 bp, Homo sapiens
cttccatctttcctgtcaccagattaatcttcctaagggacaactctgtggcccacctgtttaaaaaaaaagtcaacagccttcccggccttctgaatgtagcccaaacctgaatttatatcactataaagaacttctataaataaccactaaattatccttccttttgccaatatcaaaactatttcaaccaaagaggatacatactgcaaatcaaggacaagcaaaacaaaaactaaaagaaccaaagggaaaagacatccaactcggtgtgatttctgaacaaagaataaaataaacacgactaccact

SEQ ID NO: 392662 - DNA, 361 bp, Homo sapiens
tgttcggaaagcattggaggactatgaatcatacttattgccactgaaatgtcctcatttgaatttacatcctatctcccttctttatgaagctttcagaggcttcctgtgccctcacaaatccacttctgggcacatgaagtcgtaaaaaaagaacaatgacaaaaataaacaccgaatgctcagcttgtcattttcagcgcctaccactgtaccctgactctggtcttcctaccacctcttccttctcaactgctacccttgctttctgtacagcgttaagctgctgttctgatcaggccactctgctcatcgtctgttcatctcatcttgggcttccctttgcccttggcattgagtt

SEQ ID NO: 392663 - DNA, 1794 bp, Homo sapiens
  misc_feature (743)..(743): n is a, c, g, or t
  misc_feature (852)..(852): n is a, c, g, or t
  misc_feature (1683)..(1683): n is a, c, g, or t
tcaagataaccaagatgtactaaaagaaacagtattttttatacagctagagagcaaggactcctggtataaaaggaaaggaatccttccctttcctttccttgggagtacttgttaactgggtctgttcagcaaactttagaagcaagcgtgtttttaaataaataagtctgagaagtaaaaagcaccactggaccactacacagaagtgcacagcagtttcctacaacagagcaagcacaattaaaatatgcctaatcgcagggatgcacaatgctcaatacaacgcccccaaaaccaaatggctaaagatatatgcacttccagaaaaatattggttttactcaaaaacaatttctattgcaaaactgcccttgaattacatgagctttgatttatgggaggtttttaaaatatattgcggacataaaatgggacttccccataaggaaaaaataaataaaactggaaataacagtagtaaataaaatgcatgcctttaaggctatcctgctgactagagatggatcacaattttggccatgagcttcccagcagtaaacataaagaggaaaactcaatcatatacatgatttgctagtatcaaaggctaacgaagtgttagagacaagtacaactttctctggaataaagaccagagagaaataattcttctgagtcttaaaagaaagatgtatttccatgaacagcatcctaaatactaccttcacaataaacatgtnacttttatgaggttacttcttaaaacagtcttaaatttaagtcattgtcatagctgtgtgctaaatgagcggagtcaatttacgaaaggaagaaaacgaaacaagtcantgaagaaaagcagttctctagcaatggaaataactgaaagctaaaactgaaaggacattaagaaatgaatagaagaaagaaggaatcgtgacatcaaagtaaattatctgacaaatacatggaatccagatatttgatgtcgcatttgatgatgtaactgatgcaggagtaccggtgacattgcttcctaagagctgaggaacccaaccaagagagaagcttgaagagaaggctctccaccccgcagaggagccataagtatctgcctgcaatcctgagattctgcagcacagatgctgacttttgttaactttcatctgcaaaacttatgaagcagaagttagaaaatattattgttagtaataacacattgctgacgaagcaaccacagatcatctacattacccaaagaattacccatagaatttagaaatacttccaaatcccagcaagataactttggtggaacatgagggcgtatctcctatctccacatgtgccttagtaaattgttggtttattagcaaatacagtataagagaaattttctaaaataaacacttcggctttagatgaattgatatgacttctagctgtctttccatgcagaacaaattgatctagcaggactatcgcactattaaatcttacttttacagctgggcatggtggctcacacctgtaatccctgcactttgggtggccgaggcaggtggatcacctgaggtgaggagtttgagaccagcctggccaacatgatgaaaccccgtctctactaaaaacaaaaaaagtgagccgggtgtggtggcgggtgcatgtaatcccaattantcagtaacctgaggcaggagaattgcttgaacccgggaggcggaggtcacagtgagccgagatcacaccactgcactccagcctgggcaacaagagagaaactccatctcc

SEQ ID NO: 392664 - DNA, 226 bp, Homo sapiens
tttaattcaacataatatttgtatctttgtctttatgcagagatattaaacaaatgcaaatttccataagcttagttacattatttgtcatacataagtaatagtatgaccatgttgtatttgttaaatgagctcaatagtctttttatgatataatgctgtataatgtaagaaatgagctactaataattacaaaaatactgttatcaaacttgtggtttacaga

SEQ ID NO: 392665 - DNA, 184 bp, Homo sapiens
tagtactcaacatcttatgttgtcaaagacctgtgtgcaggttgaagagccctcttattgactgggtgcagtggctcatgcctgtaatcctcgcactttgggaggccgaggcgggtggatcacctgaggtcaaaagttgaagaccagcctggccaacatggtgaaaccccgtctctactaaaaa

SEQ ID NO: 392666 - DNA, 160 bp, Homo sapiens
cccttgacttttttttttcaatcacctctattcttccacttgcaaattctgatttataatttatgtcagtcagtaactaagcaattctcccccagcctttgactggttgacgttattggccaattataataacactgacaaattgctactcaaattccct

SEQ ID NO: 392667 - DNA, 779 bp, Homo sapiens
tgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcc

SEQ ID NO: 392668 - DNA, 333 bp, Homo sapiens
cccgcaggagtgagggcactggccagcatgctccctctttcactgcttctccgatttggcttaccgtctataaaataaggacagtacttgctccacagttttcttatgaggattaaacaggttataacaattttactatgtatgatccagattacttgtctttaattcctatctctgttcattttgaccctgggtaagtcccttaacctccccacacccagtttcctcatttgtaaaatgtggcgaataagagcacctaccccaaggactgatgtaaggttaaagacttcatgcgaatgggtgtcatcatgcatgatgcttaggcagcgctcc

SEQ ID NO: 392669 - DNA, 384 bp, Homo sapiens
tagctggacacaggctgagtggaccttctttggcaggccctgctgcaaaccaagctgttttccagggccttgatgattctcagtggggaggcagcggctcagaccgaatggcaggagctatcagccccaaagtgtctgcacctcttctgaattccaagtcaagtcccaggggcaggggctgagtagtgaggggggtgaagaagagagccaccggctacccgaataagcccagaacacaactcccatgtttgagctgacccatcagttgtgaaaaccagagcccatgcagaggggagcattggcaatgggtgacatgggccctttgtggccttggagagtcacttcaccgctcagagacatgcctgattctgacattgggattta

SEQ ID NO: 392670 - DNA, 284 bp, Homo sapiens
aaagttcacccatttgaagtgtacaattcatttctttgcatctttgcaaagttgtgcgaccttcacataatctaattttagaacacgtaataagtttgtttgtttttttgaaacgagtctggctctgtagcccaggctggagtgcaatggcgcaatcttggctcagtgcaacctctgcttcccaggttcaagcaattctcctgcctcagcctccggagtagccgggattacaggagcgcgccaccacgcccggttaatttttgtatttttagtagagatgggtt

SEQ ID NO: 392671 - DNA, 342 bp, Homo sapiens
tcaatgcaagctgtccatgcggccttggggtgcagatccagaggcaccggccgagctccatgtggtagataagggtctctactgctccatgccggggaccctatccagtgggcccagacagaggggtcctcagaggagtaacagcagagggcacagtggggccccagggacgagacctgttcctttcaccgtcttcctgactggggcactaacacctgctgctggatgagtccctccctcagaggccccacctcctttcccacttagtcctcatgccccgcctcctttcccaccgcatccctcaggccccgcctcctttccactgcatccttcaggccccgc

SEQ ID NO: 392672 - DNA, 280 bp, Homo sapiens
gcatatcacctgtggcttggaagtacataaaatgtaggctcctctttctttttcattattgtaaagtcagagaaaaagccaacttagagccatgcccacagtacaaaatctgttcaacaagattagattgtcttttgttatttcttccttcctttgtcttcattttataaacgtatgcatgcacacagcttttaaacaagaggctaattgattaggaaaccagtgttgatttgatgtaagcaacaatccaaaaagtagaaaatattattattgtttacta

SEQ ID NO: 392673 - DNA, 589 bp, Homo sapiens
agcgcggaacaatcacttgaacaatcacgaacaatcacttgaacaatcacttgaacaatcacttgaactaagtgatggttccccgctagcggggaacaatcactttctgcgtatttgtaagttgagctccaatttcggttaggaaaggttgtctctaccatccttgaccgtgactggcatggggacagcacacactgatcatatccacacaggatacagcctctgacacctggccgacatgtaggcgggcagaagtaaacaaatgagacattctgccaggagaacaggctgaatccggcaaactgaatgttaatagggagaaatgtgaagtattgaaattaagccttaaaaacgaatggcacaagtgagatctattatttatttatccagagcttcagtggatttgaaactcactaggaatccacacctggaaaactggagcctccactcacataaatagatattcaaagcccagggccaaggaagtggtgctgccccgttccccaccaagcggttcttttgttttgttttttgttttgagacgagtttcactcttgtcgcccaggctagagtgcaatggcatgatctc

SEQ ID NO: 392674 - DNA, 385 bp, Homo sapiens
ttcagtagtttaaatgtttactttgcaacattacatattgccttctttagtgagacatttttctgcaaggaaaaacctcaattcaggaggaaaaacccaaactcagcttatacctaaaagtttatgccttttgcattagtaagattcaaattgatatggtttcgttattttaaaaacacatacaacagcagcctttttggtcaaggcacaaatgtgggctactcagagaaggaggttacttagggttggtgctcaagtattcatccaattggattgcactgctaatcagtaatgaatttatatctgtggaggtgagggttgatgggtttaagttattgatctatttcctgtcttcattattttcactgaaagctatatttccatc

SEQ ID NO: 392675 - DNA, 356 bp, Homo sapiens
ggagtatgtctttgggaaccattatcagtttaccacaccttcctaacacaaggtaacctgatggtctaataacatgtttgctggagtactagctagcatgtccacatgtcctgccagaagaaggaaagagaagagcaaaatggggtttctcccagctggctcatctttgtaaacagtcttccttgaaatcctacctgatgctggctcacctctcattggctctgtggacctagctgccaaggaggctgggaaatgcaattatttatgcacttaattgcactagggtgctaaagcataattttctccgctattgttgttgtttgagacggactcccacccttatcgcccaggctgga

SEQ ID NO: 392676 - DNA, 472 bp, Homo sapiens
tgtcacagcaagaactgagcggagaccttgctctgaagttcatgggttaagaaacgcccctccccacaccaaacacaaacatttcacgctcactcgtacatgcacacacatgcacacaagcatctatgcacacatgcacatgtgcacagctcacgaataaacatatatgcacacacatgcagtacactcacatgcaaacaggcagatgcacaggcatgggcacacatgcacaaggcatgcatgtgcaggtctgcagacacacacatctgcatgcacatacacggacgtgcacctgcacacacacaagtgcacataggcatcaaagacacacatgctcgtgcacgcgcatacacacagacatgcacacttatgcatgcacacgccatgacaggatggcacgggaacaaccttgcacatggagcctgttctgtgtgtatcgagagcctgcacctcttactgtctgcatgactgt

SEQ ID NO: 392677 - DNA, 505 bp, Homo sapiens
agcacaataggaagtatttgtgtatctaaacatagaaaagccgtagtaaaaactatagtattataattctaaaggcccattatcatatatgcagcccatccttgactgaaatgttgttatgctacacgtgactgtacttatttggcacgtccacatagggcttttttctcaaatattaaatgttgtttaaactactgacataagagttatgctagacaaagaaaaactagtgtaaatgtgatgaaaaccaaatgagactttttaaaactccacatcaggctgtgtgtgtgtgtgtgtgtgtgtatgcgcaggcgtgcacatgtgtattttgtacttattccctgataaccttttatctctcagacacttaatttgtcatttaggatatctgtggttaggaatggaaggcccattttgtaattggtcactatgccagaggtgaaagccattgacaccgagcctccggggacggagaactcttggcaaggcttgctaccagtgggtg

SEQ ID NO: 392678 - DNA, 872 bp, Homo sapiens
gaaattttaaatagcaaatgatttttttctgtctaaagcattttaatcactcctggaagcttcttcctcactcttcacaatggatccattctccctatgccaaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcactgttcatttctattacaataatatcttacaactgtacaatattagaacattactactaaataatgaacattgtcattacatcatacgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaaaaaaaaaaaaaaaaaaaaattttgggggcgccgcgccaaaaagtttaaccttctttggcccggcccagtaataaaggccagcgccgagaaccgccaagggggttcccaaaaccgggccggttggaaccggttggtccgcttcgcttccccccccccgcgaaagaaca

SEQ ID NO: 392679 - DNA, 400 bp, Homo sapiens
attcggccagtgggagttcccccaagctggttcctgtgtcctgtgcatcacccatcttctttctcctttacttctttcttaagccacttcctttctggcatgacagcgtgttccaggatcatcttgtacttgcacctgccctgccctggccctagaatcagccaattctttgaggcatcctgcttccttttagtgggggaatgatttgagaacaaaatatactactacatgatactacattctgacaagaaaaaaaacacagccataagaaataaagccatggccgggcacagtggctcctgtaatcctaaccctttgggtggcggaggttggaggattgtttggggtcaggaattcaagaccaacctggcccgcatagtgaggcctcgtctgtattaag

SEQ ID NO: 392680 - DNA, 861 bp, Homo sapiens
ctattggccgagttctgtgagcaggggcttctgtccggaggctgtttgctccctctctgtcttagaggttttgctcctggtctctggctggcctgcccagtccctcaccctgagaagggctcagagctatttccagtccctgctgtgctcattttctctctgtaaattccctggagtggaaacagccccggcaaggcagggtacagctttttattgttttgaaaacgagtcacagctctgggcctttagactggggatctggtgtgggagttctggaaggccaatagctgggcccctgggagagctctgtgtggggtctgcaccaggccctgcagccccgggtagtaagcactcaccgaagaccatgctgccctgcactgtgctggggcagccctctaaaaggtggttggcagagggagcccaatgtgtaacaaatatgtgcaagacagtgccctacttgtggtggaaacagagggccctaaaggggcccagaggacaataggaacaacagtccgtttattgagcacttactgtgtgccaggcacagttcaaagcgctttcatgaattactgtatttaattttcctaccacccagtgtggtgggggctgtcactgtctgcattttgtaggggaggcagcagagagtggaacagctgagttttgaaccagtaggtctgacctcagagcccatgctcctcccccataaccctggggtgctggaagtcgtcttggccctgaaggacgaggggtgctccacctatgaaggagaaggagggcgttccaggtagagggaactccgggcagatgtggaggtctgagctgcctcacctctcagacgcagacgcgccttgaactgcctgt

SEQ ID NO: 392681 - DNA, 271 bp, Homo sapiens
tctcactgtgttgcccaggctggtctcaaactcctgggctctagctatcctcctgcctcagcctcccaaaaggctgggattatgggtgtgggccaccaggcctgtaatgtaatgttgcattatggcctagtaatgtactgttgcattacattaaataatgcatggatggagcagtgtggaaaagaacttgacaatgactacatctgtgacctccagccctctggagaagtgcactttacataggagaccacagatgtctttgagaagtatt

SEQ ID NO: 392682 - DNA, 463 bp, Homo sapiens
tgacccttttaggtaccaagtcacggagtggccagtggcatgtgacctcggagctgctgactggggcaaagcactcaacagccaccgtggatgtggcctgggctcagagcacacccctgccccccagggagggccagggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgcaagccatcctgcccctggccatggacacagagatcatcaacacggccattctgactggccggacagtggccatccctgtcaaggtcattgccatcgaggtgaatggcctcgtcctggacatctccgccctagtggaatgcgagtctgacaatgaagacatcatcaa

SEQ ID NO: 392683 - DNA, 319 bp, Homo sapiens
ccccacttccaagatgtggagatggtaggcacacggggtcctggcactaggctgggaggtgacagagctggggtcccgtcctgagaggctctaccatctgcaccaagctccccctctccccatggcttgtgggtcagatccaatgagacggtgaacatggaagtgctccaggccatgctccctgaaagcagctgctggcactgtcatccctgcactatgaggaccattcccacagggaagtccaaggcagcatgagcgccaggaatgatagggagccgtgaggagggcccaggttcctgggcggacgctgcagacactc

SEQ ID NO: 392684 - DNA, 765 bp, Homo sapiens
ctgtggctggctacttttgatagcttaatccctatagcaacttcgtaaagtagatataatccccattttacatatggggaaactgagtctcagaggttttatattttgtccagggccacagagtaaattgtatagtctggattcaaactcaggtttctgactgcactgcccattttaactattttgactcagtgtgtttcatcgcttaacatggcggaaaaattgtaatggaagttgtgggaggtagcatgaggatgggaggggaatgtgcatattcatcatttttagttggggtgggaggcaatagaggttaagaagttaagggaagagtagaagcattttatagctgctaaaaaggtggatagtattataggtaccaaaagtgccccacagatagctacaaattctttagctggtatctgagatttaacaacatggatgtaggtgctcaccagagaggaagatgccaattaagaactcaggttataatttcagatagagctgtttctcattctgtaaccagaggcagagtaatccggcataagttactttaaactttggagtcaggaatatgtgatatttaggaaaaaaggatcctgtaattatgagtctcttttgttgtctcttccaagcagcgtatggcctattgggctttttttggacaagggcacctgagaagctccgtgtgatacaggagcagtagtacaatcatattggttctattacctagtcatttctgtaatactggctattagaaaaaaagaa

SEQ ID NO: 392685 - DNA, 392 bp, Homo sapiens
ctcggctctacctagtctcggctctacctgtctcggctctacttgtctcggctctaccttgtctcggctctaccttgtctcggctctaccttgtctcggctctaccttgtctcccaacccataatttgctcagggatgggagacagggaaggtggggagaattataaaggggcaagaggaaactttttgaactgatgcatatgttcattacctggattatggtgatggcttcacaagtatatttgcacgtcaaaactttttctattgtgtactttaaacaatgtagtttattgtgtgtccattatacctcaataagctgtctaaaaaagagcaaatgaacattttgttagaggaaacctgcttgtcaaggcaaggagttatgaaaccccaca

SEQ ID NO: 392686 - DNA, 142 bp, Homo sapiens
agagaggtgacattacaaattggtggggaaagaataaactatccaatgaatgatattaagacaactagttatctcaacatggaaacagataaaatccacaccttaacttagacaaaaataaattccaggagaattaaagcag

SEQ ID NO: 392687 - DNA, 321 bp, Homo sapiens
atggttaaatctttaaaagttcaaggacatattctgagaggaaacatgatattcttcttttcacagcatgaggaaaataaatattaattagcctttttctgaactggttttaggtctgccatggttggttgctgggtcaataggaagtcagtgttgataatctgtgtgtgtgtgtgtgtgtgtgtgtgtgtgtgtgtgtctgtgtctgtgtgtgaatccttagtcatgtggggtaacctaggcgtcagaaacctttgaagggttttactagcaaatttgatttaatttatttcaagggaaagctcagtagaatttggttct

SEQ ID NO: 392688 - DNA, 590 bp, Homo sapiens
tgtttaatgtaaccattgaagaaagatcaaaacagtaaatctgtcatggcaaggaaaaagtatttaaataaatgttttaccttatgcactcatcatcttgggtcctgaaggagttcatttgattcctggggcaggggacaaaaggaatatcaaatatttggcaagattgcaaaaatttctctaatcaaaaaggtgccatctgaccatgttttgccacagaaagcagttctcaccaaagtttatcatggcatgtcatagtggctgtttgctgacagtgtgtgggttttggccattcagtggatgactgggaaagggaaataatctactaattgctttcccttgggttttttgtttccctggaagaactttaatcagtctgcttctattgtttatgttgaagaatagaatgaaggagtgaggtaaaatatactaataattagatgatttgatactcaatatgtaaataataggtgggtttaaaggcacctcacacaatgtatagatttcagataagatgagggaaaattaactgttttgtaattggagccctaaatgagagttaggtcccattgccacctacgtttgtgtta

SEQ ID NO: 392689 - DNA, 831 bp, Homo sapiens
gaaagatcgctgagctctccgaggcagctcgtctcccctccccctcggaatccggttgcagcccaccccaccccaatccggatccggcagccagtggggctccctgatacttcttgggaagcggtcaggggttaactatggactctccccaacccctcctgctttaggtgtccaacctgcagggaagtcaacagaggccctaagacgttattcctgggcgtggtgcagagtatgcggcccggggagggataaaacgggtcccagtggctccatatcctacctgcctggccgccctagctcaggccggtccccaggctggcccaggctgcggatcgtgggcctgcagtggcatcttcacagagagtgcggcactgcccatgctgcgctgcacccagaatattaaaaaccacaagcgggttggagtgtaggagcttgttaatgcatttggtggcggggggtgccggggagacgtggagacttccagatagcacactgaaagcaaaacattgccagtgacttctgaaagtgaagctcttccctcatccgggcctgtttggggctgagggaagggggaggggtgagaggtgttattttaaaagatctggctttattaatacgttaagaaagagctcccttggcagtatgtgttctcgcagcgcccgctctgatcctataaaacattcatgctccgaaagctgttacagagagctgacccccaagcacacccaccgacaggcctcagcgggaggcttctgccctcaaagggccactagggcccaaatacctcttctgtgaagaacccgctccagccctctgactcccaggttccgg

SEQ ID NO: 392690 - DNA, 411 bp, Homo sapiens
tcccaaagtgctgggattacaggcgtgtgacaccgaatatatacatcttaatgagtatagagataaatattcgccccaggactcatcacaacaaataataccgtaaacttgaccatcaccccccatatatttctcattctcaccctttttaaaaaatgagaccgggagtggtggctcacgcctgtaatcccagcctcctgagtagctgggatcacaggcgtgcacccccacgcccggctaatttttgtatttttttagtagagacagggtttcaccatgttggccaggctggtctcgaacgcctgacctcagatgatccacctgcctcggcctcccaaagtgctgggattacaggcgtgtgacaccgaatatatacatcttaatgagtatagagataaatattcgccccag

SEQ ID NO: 392691 - DNA, 519 bp, Homo sapiens
agttatgcaacagaagactccccgtgtgggtttatatatttacatacacatgtcagcctaaagatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttggg

SEQ ID NO: 392692 - DNA, 336 bp, Homo sapiens
tgtggctatagcgcaagctacaaaaaacagagtgcttagaaatgaagctagacaggtgggttggaaacgctgcaaagtgctctacatcaggacagagttaggtgacatcaaactctagaggcaactagtagccatggaagaaatttacaaaaggaaatcacggctggacgcggtggctcatgcctgtaatctcatcactttggaaggccgaggcaggcagatcacaagcccaggagagcagcctggccaatatggtataaccctgtctctactaaaaatacaaaaattagccaggctttggtggcacatgcttgtagttccagctactcaggaggc

SEQ ID NO: 392693 - DNA, 183 bp, Homo sapiens
ggggaaggggaggggaggattctgcatccagggcaccggccagcacaggcccatgttccatgggttcccactgtgaccctcaactcttgctgcccctttcctgctctgcctgcctcctactcatttggcacatgtgaaactgagacccataggagtgtgggggcaggcttgtatctgggtgaa

SEQ ID NO: 392694 - DNA, 307 bp, Homo sapiens
tcagacacacatgcacacactaaaccatagagacagggtaagccagaggcagggccagaaataaccagatcgaatgtttgcccgattatctattttaacttggctttttattaaattaaacagaatctctccgggatggaaatccttggctcttaggttcattgggtcccttctgcaccagtctctgccagtttcattgagtctgttctgcaccagtctgttggtttcaatatcccaccaactcctatcccacctatccctactttggatgaatggatggttaggataagtttgggatgttatctca

SEQ ID NO: 392695 - DNA, 806 bp, Homo sapiens
gtatgggaattattttttatgttaaatagaaactgaatgtactgggttgaatggtgtcctctccaaaattcatgtacttcctggagcctcagaatgtgaccttatttggaaatactgtggttgtggttgtaagtagctaagatgaggtcatactggagcagggcaggcccttaatccaatatgactggtgttccttataagagaagatagggcgggcatggtggctcacgcctgtaatcccagcactgtgggaggccaagccaggcaaatcgcttgaggctcaggagttcaagaccagcctggccaacatggcgaaaacccatctctactaaaaataaaattagccaggcgtggtgcttgtaatgtcagctacccaggagtctgaggcacaagaatcactcgaacccgggaggtggaggttgcgagatcacaccactgcactccagtgtgagcaacagaacgagactctgtctcaaaaaaaaaaaaaaaaaaaaaaaggaagaaagagaagatagagacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaacgtatttctgctgttttaaggtacccagttcatggtaatttgttacagcaatcctaggaagctaatactctgacagaaaaaaatcttggataatatgcatgagaaaaatccttcaataaac

SEQ ID NO: 392696 - DNA, 694 bp, Homo sapiens
tacagtcttgtggttaagaaatcaaaataataaagaagatacggcttgaggattcttgctctgcactggtccttccgccaggacctggtgcgtcccccaagagggccttgccatgtgcgagctgagacacatgttcacactttcctccttttttgtacaaaaggtagcacatggtaaatagcgtctgcacgcttctcccctcgctctgtcttcgggactactccacatccatgaagaagcagcatccttattctcttgcacagtgggcagtggctacactgtattcactcgtctctgctgatgggcactattgtagtggtgcaattagtaacctagtatacatgcccttcagcgtgtgtactggtgtatggatctcacattcccagaggctgagtgaaagaataaaggctttttgacagtattcctcaggtactcacacactcgctctgtgagccacgtgatcatgggagcggctccctgcagaggtgtctgatgggagaggctgatgtccttgtctgatggttgctccaacctgagaatggtgagctgctctcccaatgcagactttcatcacttgcatctcatgcgtgagattgaactgcttctcatttatgtttttatctttgtttgcccatattttagctgggttgctaatcttttaatgttttctaggcgcttttcataaattagggag

SEQ ID NO: 392697 - DNA, 365 bp, Homo sapiens
gcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccag

SEQ ID NO: 392698 - DNA, 141 bp, Homo sapiens
ggcccatttggtcagcttccccgccacgggcacctcgttcttccacaccctgtcctggtggggctgtccgggaagacacctaccctgtgggcactcagggtgtgcccagcccggccctggctcagggaggacctcagggtt

SEQ ID NO: 392699 - DNA, 845 bp, Homo sapiens
cactttttctagtgttgatgaggacagagtgcagccttttcctcccctaatagaaaagccattgccctcttttcctcccctaatagaaaagccattgccctcttttcctccacccttaagaagacctgcatctgttggaccaacagacaactatccggcttacggccaggggagcccctgcagctgcacagaaccagtttcttatgtatctggcggtaattgggaaagcttctgagaaagtaagaaagacatgggtgttggggtggctggtatttcttgttctttgccaggtggactcagctcaagaacatgtttattggagtcatgttctgaatccccctgtttttaatgtgattatgtggtgggatgcagacccgcctttgtcatctaatgatacttcttggacaggaggtagatggatgcccttgtcttaccccttaactgaaatttaggatagattaaactcagtgactctttgactctattgtctagtaatcccctgacttgtttttccacaattactcacaataagtgtattactgtcattcctcaggagtatctttactatcagcccaaaagggatgctaagcttgcaaatttgtcctttatttctgccgttagactagtcttactgaggtctctaatgaagttgtacaagtgccggatcttcctatatgctgtctgagtagagactggccatataagtttgaggccatccagtagtccccgtgcagacaacctgcgccacgtcaggggcctctgtttgataatggcaccttacttgattggggtccccatggtaatctcgtgtctgcaaatcagactattgggtttggcagtccctc

SEQ ID NO: 392700 - DNA, 169 bp, Homo sapiens
ctatattgctttcatttggctactgtaacaaattaccaaaggctaggtggcttgaaactagagatgtattcttattcagtagtggaggccagaagccacaaatcaaagccttggcagaagctaggggaacaaatccattctttacctctctcttagcttcggatagctg

SEQ ID NO: 392701 - DNA, 351 bp, Homo sapiens
agggcaggggggcaggggcaccgcaggttcgctgggaaacctcagaccttcttaggtgaacccaaatctccttgctgtgcttgtctcacagtaacacatcccagtcgtctcagcctatcggatgctaagtgcttcaagtttttgcatttcctttggtagcctggacttcatgcattaacagcatcaggtgagcccaaaccaagaacatccacatcctcacctttctccccatcccatctctttgactgaaggtcatcactgagtagccctataagctgcaatttccaggccttaaagggcctgggaaaggagacctacttccattctggactccctcactccccaccacac

SEQ ID NO: 392702 - DNA, 360 bp, Homo sapiens
tgaaaccctgtctccaaaactaagctaaactaaaaaaaaaaaaattctgatgtgactgtgattttactagctcaaacataatgagctacaaagtgagcaaagttcactatgactacaaatgaaaagttgaaagaaatccattgtcggcagggcgcggtggctcacgcctgtaatcccagcactttgggaggctggggcgggtggatcaccagaggtcaggagttcgagaccagcctgaccaatatggtgaaaccccgtctgtactaaaaatacaaaaattacctgggcatggtgacaggcacctgtaatcccagctactcaggaggctgaggcaggagaatcgcttgagccggggaggct

SEQ ID NO: 392703 - DNA, 258 bp, Homo sapiens
gggggttagactttgtttttcaggagataaagagttgctacaggatttcaacctggaaaatgatattggatttatatgccagaagaagcaatctagtaatcatgcacaataaacaggaggggagtgagattgttgtccataaagagaccagttaaaggaaaaatttagtgtaatagtacaggcacataatgagtatggcttggaccagtgacaggtctgaagagttagactcaagactgtgggcctgaaggtgagagt

SEQ ID NO: 392704 - DNA, 181 bp, Homo sapiens
aggtccaacgataggatttgctgtgttgggaggtggtgagttccccattgctgaaggcaattaaagaaactggaggtcacttagcacagatgtcaaggatgggactcatatagcaggttcaggtcgaactgaatgacactggagaatcctttccaactcagagtgaattataggctagctc

SEQ ID NO: 392705 - DNA, 460 bp, Homo sapiens
attaatttgctcaggaaccttattcttttctcctcatagaaaactcagaaaatcccaatctggttgcaatccaaattattcagattaatggtcagtgtttcttaacctttttaaacctaggtggattttgatactaaaattctcatttctgatcccatttctggttgagaatcactgacacaaatttaattctatatgtatatgctttaaaaaattacattcatttttttcttttccccctcacctcaatctcaatatgttatatccattcttgacatctagctctttattattaagtaaggtattctgtgcttgaaacaagctgattttcctcattcagaattttctagagcactgtttattattacttcaaaactttagacaaaaattgccaatagtaatcaatgacacaaaattggaacacatacaaaacatcctttctaactcctttattatttca

SEQ ID NO: 392706 - DNA, 140 bp, Homo sapiens
gcctttatgtttggccacatcttagtgactgatggagatcagaccttaatttagcacacacaggtctgctaggacaagagcattctcagtgacaaaaacagtggaattcaatttctcatacagtttatgagttgtaagga

SEQ ID NO: 392707 - DNA, 447 bp, Homo sapiens
ttttcagcttgcttctccctccctgcaggaaaaggcaccatcacatcacctttggtcctcgtgatgctcttagctcaagttctttgtcccgtcgctaccggtgtgattgttaatcctcagatttgcagcaaacattttagattttcattttagattactttagctatagccagagcatcttaaagccttatttatgcactgaaatacttctggtctgcttctgtgcatctgaatgctatagaatgacagtccaccaggcacgtgcatctgtctgaggacaatggccaattctgaagcagacgacattactctgttcctttcttgagcttactattgggttggaagagggaaatgaaaacatgacttatcagaaagcaacctggaaaacactatgacatggatttctcaaacttaacacagctaaaattcagcttttatttgaccatc

SEQ ID NO: 392708 - DNA, 340 bp, Homo sapiens
attgaaaagttctgagcaggtaagaacttcatcataggactcatgaagaagacactggcatggcacaaacagttcaattttacagggaagaaacacaacaaataaatgggaccaaagaaagctaccgcaaggcccacacaggaggtaagtgcctgaaattgtgtggtgaaaatgggcaagaaggaaggacttaatattgaaaagatagaacaggcaggttgtggctgtagtctgtgctgcagtgagagaaagaggagaccaagaaagaagcacggcttgaacctgggaatccgagaaaatgggagcacctttagcactactggaaggtccagaaggaaaa

SEQ ID NO: 392709 - DNA, 792 bp, Homo sapiens
atgcggagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgacgaaggagacgaggtattcctacaacactgaatggaggtcagaaatcatcaacagaaaaaacttcgaccgagagattggccacaaaaaccccaggccatggcaagaggagtcatcatggcaacagaccctttgtccaatggaagtttcctctcgtaggctcatcgcaaggcgaaaagcagtcccggccttccacggg

SEQ ID NO: 392710 - DNA, 551 bp, Homo sapiens
  misc_feature (505)..(505): n is a, c, g, or t
atgcggagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggcggaattccgagatctgaagaggccatggaaccagtctcacatgcttttgtatccttccctaagaaaaatgtgttttcatgtacaggaagtcattgtcttcacttcaccctcccccagttgtaaatntccttgctgtacatttctgttaaatccacaacactggttatatatt

SEQ ID NO: 392711 - DNA, 956 bp, Homo sapiens
atgcggagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaatccaaaacctggaagctgtcaagatacccatccactgacgaatgattcagcacactgtggtatagtcataaatggaatactactcagccatgaaaaggaacaaattcctgataaacaccacaacatgaatgaattgcaaaagcagtgctctgagtccaagaagctgggcagaaaggagttggtgccctgattccatttttctcaagttgtagaagaaacaaactaatctacgtattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgacgaaggagacgaggtattcctacaacactgaatggaggtcagaaatcatcaacagaaaaaacttcgaccgagagattggccacaaaaaccccagtgccatggcagtggagtcattcatggcaacagcccc

SEQ ID NO: 392712 - DNA, 638 bp, Homo sapiens
ggtgaatattataacagctataccttcacccagctacccttgctgggctctaactcgctgtctctttctcttgttattgttgttgttttcccccatgggtgagttctttatggcagtctccaccatttcctcataatcattttccttttgatttctatattctgacatccagttcccatcatactgcggcagctgatctctcaaaataaattcattgatttttttttttataattgcagttacattttttctcctttactttccttgcacacaggactgtatttgatgctgttaattaacccttctttaaaactttgttttttgtttacttctgtttctttactgactgtgtacagtaatcagaaaaatcagaaaaagacctgattttctctaaatcaggcctttttccctcaaggatctttgtggccatttcccctggttttccttgaggagaaaactatctctctacatctccctcttaacccaacttccactccgctattttaatagtctactggatgctacggtgaacaatttaaaagacagaaggactgggtgacaaacgtgagggaatttggactgatgtctgcatgtctggcttgagtaacagtagggacagcagtgctgtttcacatata

SEQ ID NO: 392713 - DNA, 440 bp, Homo sapiens
ttaaaaatacagtccaaacttctacccaatccatcccccaaaactaccattgaacttctagctaattgagggctctcaaatttctgatttctcacagttctaactgaaaagaagcaagggcactcttccaacccaagtggctggaaactggctcagttcctctattttcaccgattccaagttattcttattggttcctctagtcataatgggaggaatcaacatcgtgttggttccagtactaatgaaaaatccaagttgtggtgagtgggcatgtgtagtattacaccttacctattcagacgaagtaacagagagtgttaacttaaaaggtccacatatggacaattaaatcaaataagaagtaactgtcactcataaggagtttttaaacattgcttaatagtgctaaaggctgaagaataagattctttctggag

SEQ ID NO: 392714 - DNA, 399 bp, Homo sapiens
tgcaggactaacaaattagccacaagattagaaattatgatttaggagtcactgttgtaaaacctgagatcagtgcttgaggtattttgcagaccctgcattccagtgcatcacccagattggtaaattagtttgcctggtcttgtccccacccaggaactgattcagcacaagaagacagctttgactccctgtgatttcatcttcgacccaatcagcacttcctactttctgaccccctacccaccaaattatccttaaaaaccccaatctccaaattttgggggagattgatttgagtaataactcatacccacaaggtatggctggccttgtgtcagttaaactctttctttactgcactgctgtggtctttattgtgcagcaggcaggaataac

SEQ ID NO: 392715 - DNA, 385 bp, Homo sapiens
ttctgagaggtagttctgactacaaagggcaggtgattctctgcagccagtgagcaggaactttgaccctctggaattgtgctaagcaactgagagtaaatgaatcaggcagcagggcaccaggaggagtccactagtgtctttgtgatggttttgtttttacaggactcatttaataaatatttcactaggcacaatgctgtgcattttttgtcccagttatcatatttttataggtatttacttcataaaagtaacatttttatgctccctttaaaataggattcttctattagaattgcctagtaaaggcaatcagaggaccactgcctaaggaattcactcacggagcatacatatataagtatatgctctatctctatct

SEQ ID NO: 392716 - DNA, 560 bp, Homo sapiens
cttgctgtctcagggtgtgccaggtaggttaggtggaggtggaagggaagcaggagaaagcaggagagttgggcacacttggtgtaacttttattgaaaaaaatctgtctgtaagtagacccgtgcagttcaaacctgtgttgttcaagggtcaactgtatgtgtggttttgaattctagtctttagctccttttaaatgatgtgacaaggagactgaccattatgaggtgttcactatggtccgaggaatggcaaatttcacccttatgagactcagtgtgtttttattatcaacctttattagctaatggaagttaactgaaatcaggtaggtttatagagtgttctgtagcatagtgagtcaggcattgtgaaggtatactaatgtgtggcacaaggtagttactcattttagcctagtgtgagcagcagagtgtatgtgttggtaactatagtaacaaaaagagtaaggatgccagggatatttatatttttttgtagtaaagatgaggaaaggaggaatttctctttagtgtgttgctgtaaatgttaaatatga

SEQ ID NO: 392717 - DNA, 454 bp, Homo sapiens
ttctgggacctttgttgatgtcataagttacaggtagaatgcgaatgtaactcaaagtcctctcatgtgcaagcattaccacactaggcaatgttgggcttccctgatggctggaatctgcccatattaaataagctaatcagtttccttgctactcatcatgtgatttttttcagaaagttctaagctattaaactacttactttttcactctaactattgtataatgatggcactatttcttatgccattatatgacaggcatagttttgggtccctttacaaatgttcttgttaaattcactaaacaagcctctgaattcagtaggtaaatcaactgtatataagacagaaaaaaaaacccttagggttattaaaatggtggatatattgtttaataaccctaagggtttttttttctgtcttatatacagttgatttgggtaccgagctc

SEQ ID NO: 392718 - DNA, 318 bp, Homo sapiens
attaaagctgggttctgaaggaggcagaactgtaattttgatagaccaggacatcagttgaaagaaattttataaggcagaggtgtgaaaaagggaagcccattccaggagcttccagatgtgtgtgagtggaggggatgaacagagcctagaaaggtcctggagcggagggacctagaagacactcccatcctggtgatgaagctttttttttttttttttttctgggtgggtttaaaacaagagaagtcggcctctctgttggcccagaggtgggaggtgtcgaaagggcgcgaactctggggccccgcggcaaca

SEQ ID NO: 392719 - DNA, 311 bp, Homo sapiens
caagtgattctcctgtctcagcctcctgagtagctggaattacaggtacatgccaccacgcccggctcatttttgtatttttagtagagacaggtttcatcatattggtcaggctggtcttgaactcctgacctcaggtaatccgcctgcctcggcctcccaaagtgttgggattacaggtgtgagccaccatgcctggcctctctggattctttttgctctggagaagttagctctctaatttttgttacttaagctgtctttttttttttttttttttggggaacagcatatcggggacccgagcccga

SEQ ID NO: 392720 - DNA, 183 bp, Homo sapiens
tatatatcaggtactatatatacaaatatgtatgtatatggtatataataaaaacaagaaagcatatataatccaaaattgattctcaaaattggtgtacctaacatacacttagggaattgattataatcacaaatgtcctggttcagcctaggcctacagatcagaacttcaagtccccta

SEQ ID NO: 392721 - DNA, 267 bp, Homo sapiens
ggtgtgaaattaatatgctgtctcactggagcttgctttttcagctgtatatttcctgaagtgaccagcagtagctttcatctcctttccctcctcccgttgtgctcattgagaaaagaatgtgattattgtttaattaaatgacttgacttttatgggagattaaagcaggcaggctttgatctgtaacaccattgccaacaccttttttgaggatatgctaactaccagcagaaagctaagatccgcagattttaattaaagact

SEQ ID NO: 392722 - DNA, 248 bp, Homo sapiens
cggaggtggggataacagagccattagcatagacctgatatatcaaataaaaaaggataggtaaagagggaacatcgggtttagtttagtttttctgagcttaagaagccaacaggatggaggatacagatatgagatggacagttagaaagattagagctgaaggtgaaggtcacaaccaagctatagatttgggggtgaaatttatgaaagtgaagggaagccacaggccatgatgagactgtctg

SEQ ID NO: 392723 - DNA, 484 bp, Homo sapiens
tagctcctgattctttttgacatggcctcatcatttttctttatttcctctaaaaaaaaaatgagatacgtttgcagaatgtgcaggtttgttatataggtatacgtgtgccatggtggtttgctggccctactgacccatcctctaagttcgcccgctcaccccctaccccctgttgtgtgttttgttaccctctctgtgtccgtgtgttctcagcattcaacttccatttatgcgtgagaacatgcagtatttggttttctgttcctgtgttagtttgctgaggatgatggcttctagtttcatccatgtccttgtaaaggacatgatcccattcctttttatggctgcatagtattccacggtgtatatgtaccacatttcctttatccagtctatcattgatgtgcatttggattggttccatgtttttgctattgtaaaatagtgctgcaataaacattatgtgtgcatatgtctttat

SEQ ID NO: 392724 - DNA, 707 bp, Homo sapiens
aactcataattggaggactaacactacttaatttcaagacttatcacaaagttacaatattcaagacagtgtggtattggtatcaaaataaacaaacagatcaatgaaatcaaatagggagtcctaaattagatgcaaacatatatggagaacttatttttgacacaagcacaaagacaattcggtggaaaaaggatattcttttcagcaaataatgctggagcaattagatatctatataggaaaaaaatgaatgccgatccataccttgcaccatatgcaaaaattaactcaaagtaaaatcatacacctaaatgtaaaactgaaaactataaaacttctagaagaaaactttggcaatcttctcttagacaaagatttcctagatatgacattaaagtataacctaaaaagaacaaactggtcatttaaaccttttcaaaaataaacttgtgtttcttcaaaacacactgttaagagaataaaaggtaatcctcagatggggagaaaatatatgtgcaagtcacttatctgataaagtacttttgtccagagtatttttaaaactctcaaaactcagtaataaaagaagtaacccggccgggtgcagtggctcacgcctgtaatcccagcactttgggaggccaaggcgggcagatcatgaggtcaggagagcgagaccatcctgggtaacatggtgaaacccc

SEQ ID NO: 392725 - DNA, 269 bp, Homo sapiens
aggctgtgaagtccaggcacagtggctcacatctgtaatcctagcactttgggaggccaaggagggagaacttaagccccgaagttcaaggctgcagtgagctatgattgcaccaccgcactccaggctggctgacaaaataatttaaaacaatttaatttaaaataatttaaacaaattaaataacaaaaggctctgaatgtacagttaagcaaatgctattcctgatgctttgctgccatctctgatgaggcctgtaaacaatcaag

SEQ ID NO: 392726 - DNA, 357 bp, Homo sapiens
cagtagtttgcaacttaggcttccatactgaaatcacatggagacccttgagaattgccacactagttgaacctcaggggtggacctggctgtctgtgtagctggggcaagaacttctgatttcagaatggttgaagcatttcctccctcggatcatcagccagatctagaattacaaggccatgcccttatgagtgactgggtgtccttatatgatacctctgctgccaaccctcctggggcctgcacaggggtctccttgcagacccctcctcccctgctcaacacctattttccttaaaggttcagatttccagttgggttcagggaccttgaaaggaatccatttctctcgac

SEQ ID NO: 392727 - DNA, 491 bp, Homo sapiens
gctttttcctctagtgaacatgttctcactctctgaaaatgcatccatcaacttttaaacatgaagtcccttccatcttaaacagaaagcttacttcacttcaccttccagcctctgtacactcatacatccattcatccatccatccatccatccactaactggctcaataaatactgagtgctgctatgtgcctgttctaagtgctgggtaagggatccagctcctggttaaaaatctatgtgctggctgctacaccaaaaataccataggccaggcactgtggctcacgcctgtaatcctggcactttgggaagctgaggcaggcggattgcttgaacccagttcaagacctgcctgggcaacatggcgagtccctccatctctacaaaaaatacaaatattagccaggtatgggggcacacacatgtagtgccagctacttgggaagccgaggtgggaggatcacctgagcccgggagtcagaggtt

SEQ ID NO: 392728 - DNA, 333 bp, Homo sapiens
agttcgacggagacttctttgagaaatgaaaccatctgaggaaaaagaaggctgggctttgtaatatgggtcaaaccaaatggtggcccctactactaaggacactggtttctagcctgtgagtctcctttaggttcagtgagcttcatgttcaccaggaaggaaggcacgtttttttcctccttccttctcttccactcccctttgagaaatgaaaccatctgaggaaaaagaaggctgggctttgtaatatgggtcaaaccaaatggtgactctcaagactgagcatacattatattcaccagggaagggtttttttgtttttttggtttt

SEQ ID NO: 392729 - DNA, 421 bp, Homo sapiens
tgcagaaagcagacataccaaagaattacacagaaagggaagggagaaaaggctgacagagtgactcagagacagatggaaagaggctggctggaacaaaggcacttgaagagctgtgttgtataaaggaatgcagaatgagttatacattgacagctggaactgagccatatgggtaagggtgtggttggtcatttccctcatttgcgcattctggcccctgtgattccacctggaagacagcagcttcgtgctgagtggggtaaagaggagcagcacaaaagaagggtaaatagggggttcacatcaatctcagagacagaagctttgagaaggactattcatccagtcacctggcaccttctccagagcagcagttgggaccaaaacagtacgggaggagggcaatgagacaagtggt

SEQ ID NO: 392730 - DNA, 463 bp, Homo sapiens
cacttcacaacttagtaatggaagcaagcaatatcaccaaagatccctggctctctggctttcagcaccaattcagaacagttttacaaatgcattagaactctgctaactatagaggtagtctgatgtaatttgacacacgttatttccaaaatgtcatagattaccctcccaccccccaaaaaccttgtaaaggccctagtgaaagatctttttccatcctgtatttcctcatttttcaatctgttaggttttcagccttttttcccacctactgttcctcctcaaactgccccaacagattttgagtagagttacattaccaatccatttcacaatcttgatgttctaattcaaaacctatgtattaatgtgtgcccatctgcattcctggaaagctaatccaataatgtatcctggaaaatgaccaatgaaggtacttggtgttgcttttcagtcaaaa

SEQ ID NO: 392731 - DNA, 529 bp, Homo sapiens
tcacagatgctcatgccgttcacctgcttatacacatccagtgacggctcaaacaaacctgaaagtcgagagcatggcattcaaagcccttcatgttctgcttcccctgacattttcctcaggcacccgtaacctgtctctacaccaattatgtctgaatgccatcactactaggaaaggacagtaaatttacttgcgcgtggtaaaagttatctttcttgtctgctgcccccagccagccactaaagagaagagccagtgctggttcatacccacagggacgcagaccacacttctttgtaattaatcgcaagtaatgatctgccttgtataaaaacgtatttgaatatccacggctggttttacacataattttccgactctttcaaagtgacacatgctgaatagcagtgtgaatttacagccaggctttctaagccattatcactgctttaatgacaaaatactgtcaccagcacctcaaccttcatccaagttcagtttcttcatttcacctgcatcaggactt

SEQ ID NO: 392732 - DNA, 559 bp, Homo sapiens
ccccaactaattaaatggaaccccttcttggccagggggatcccagagaaaccttgaaaactgagttcctagccataaccagacaggagctcagacttaccacattatatcctctcccttgctaaccatcatttggctttctttcctaagggttaaacagaaacaggccatctcaaaagacttgttccatcactgtttccaaccaaccacctgactctgcccctcgctttatacaggtttgacacggccaaccaagcaacattccttcctgataagatttgcacacccagaactagcttctgtttgcatgaagtggttctggtcagtttacgggggctgcacactgagtgccttcatgtcctctaattcaccttttgacacatggggccaaattatagtatacttaaatgttatgttttcaccccaaaatgaacatggcatgtatatgacattcatattaatttactgtgcatttgcgtgcccttcttttgtgaatattcatagctcctcctataacttgagtatgtatacttagccattctgttagcataaattcctg

SEQ ID NO: 392733 - DNA, 242 bp, Homo sapiens
gcatgtggacatgtatatgtgcatgtgtggttgtgcatacaaatgtgtgtgcatgtgtgtgtgcatgtgtgttagcagctctctgaccacacagactgggccataactacgcagcccccatgtgctccatgggctgtgactggggtgggggctctatcacagaagagtcatgcccaggccagaagagcttgagagaacaaggagttgggcccttccagggcctcaaaagcacccaggcatga

SEQ ID NO: 392734 - DNA, 204 bp, Homo sapiens
tcctgagcctggcaccatcctctctcacctaggccaccatcacagcagcctcccaaccagcctcccatctccaggccagctgctatgctgcagccagagggctctctgggagccgtcactgttctgcctaaaaacttcaatagcaccccgtcgtccaagctcctaacttgctagtgcttgccacccacccacctcttggttcga

SEQ ID NO: 392735 - DNA, 166 bp, Homo sapiens
gctgattggccttcctagatgtctgttggcattgctgacactcctaaggtctggctgtggctcccatatacaccctgttcagccacatggcttctgctgaaacagccccctctctgtcctgactggctaatattactgtgatagaaagattttaccaaacatgctg

SEQ ID NO: 392736 - DNA, 134 bp, Homo sapiens
ctagtattcattgctgacgatgatgggaatgctttctatgtggaacattctgtttggaaaaagtgactgtcagtgcctctaggctctgatttgagaattgaagctttgcagtgtaggcattagcggggtgtgga

SEQ ID NO: 392737 - DNA, 695 bp, Homo sapiens
ggtttttaaaggaaagatttggaatgcagaagaagtgtgggggctgagaggtataaggtagcgtgacttgctccagtggcccctcttgaacagttgtcctatttggcaaaggggatgctgccatcgtagaccctgccaggttataaattactttcagtcaattttgtagtcactcatcatctgggagtgggttccatctttaagcaatcttttgttagagagagaattccagaggtgccttgtcactatcaggatctgactcctaaagtatataaggaaatatatgaccagataagaaagcatggtgcgtgcttgacaagcatttaggtaaataaatgtgcataaggcatgggagtattgtatggagaaggaaaaggaattgagattcacagcacatactgaggctgtattttaatatgagaggttacatagatgtgttataggttgttagacaggcatagagtagggcagaagagggctctcccctacccactaggaatgttgagtgatggtttggcaattatcacattgcctccctaaaagtgacagattggcagatggtgccaggaagaggccatttcctgatgggccacacctgttgcactgaagtgttaattgaatggagacgccaggaagaagcaacttcctgggcatatgcactaagagacaaaaatggcagagtttgcctttccagg

SEQ ID NO: 392738 - DNA, 201 bp, Homo sapiens
tttcccgtaaccattctttatgccactggtccttagtctttagaatgttagaattaaaaaagccttaggggccgggtgcggtggctcacgcctgtaatcccagcactttgggaggccaaggctggtggatcacctaaggtcaagagttcaagaccagcctggccaacatggtgaaaccccgtctctactaaaaatacaaaa

SEQ ID NO: 392739 - DNA, 329 bp, Homo sapiens
ggggattaagttaaaatgaggccattagagtgggtcctaatccagtctgactggtgttcagataagaagagaacacttgggcacataaagagactctaggctgggtgtggtggctcacagctggaatcccagcactttgggaggctgaggcgggcggatcgcttaagctcaagagttcaagaccagcctgagcaacgtggcaaaaccccatctgtacataagaaatgcaaaaactagccagatgtggtggcgcacacctgtagtcccagctactcaggaggctgagatggaaggatcacttgaacccaggaagcagaggtttcggtgag

SEQ ID NO: 392740 - DNA, 241 bp, Homo sapiens
ttccattctcatcagagcaggaaggagaggggcctgaccatatctgcatttcagaaagcccattctagcaggaggaggagagatttggaagagaggagcaaggaggtgggtgacatgaggaggtttgaaaggatgcaggtgagatttaatggcatgaaccaaagccgagcggttctaatgtggcagaagagtggagtggaaatgggggtgaggattggagggaaatttaggaggtaggatg

SEQ ID NO: 392741 - DNA, 340 bp, Homo sapiens
gggccagtacggatgtgggtcccagtgtgaggggcgggcagaggaggggcacacaggcagtgccagcacagcacagaggggaaagcctcagtgacccctttcgccccaacccaacagcagcaggcggcttctaggatattctttctccaatcccctccttctagctctcacttctgaggtccacatggggagaattcagatagacttctagtccacagtataatatggggagaaaagctgggggctgaaatgagtcagtatccaaagatcttcccggctgatttgacaggtttcacttcccttccctctctctccacatccccaccacacacacactcac

SEQ ID NO: 392742 - DNA, 541 bp, Homo sapiens
gagctacctcattgtggtagactgaataacagccccccaaaaatgtccaagtcctaattgctgaatgtgtgaatatgtatgtcacttggcaaggggcactgaggttgcagatggaatttgtgatgttgatcagctagccttcagatagggggcttatcttggactatctgggtgggcccaatgtcatgacaggggtccttaaatgtggaagagggaggcaggacagtcagtgtcagagtgatgcgatgtgagaagatctccacccatcatacctggcttcagagaaagagggtggggccgtgaaccaaagaacgtgggcagcatctaggagctggggaaggcaaataaatggattctcccccagagtctccagaatggaacacagccgtgccagctccttgattttagcccagtgaaacccacattagactgttgacctctataactgtaggataacaaattcaaattggttaagccaaaatgtgatcatttgttatagcagcaatagaatattaacatatcccctccccacaaatcccca

SEQ ID NO: 392743 - DNA, 325 bp, Homo sapiens
cgggcagatcacctgaggccaggagctcgtgaccagcctggccaacatggtgaaacctcatctccactacaaatacaaaaattagctgggcgtggtggtgcatgcctgtaatcccagctactcaggaggctgaggcaggagaatcgcttgaacccacgagggggaggttgcagtgagctgtgatcacaccactgcactcctgcctggacaatgcagagagaccccatctcaaaaaaatgaaaaacaaaaaacaaacaaacaaaaacacaaacaaacaaaagaggtgactggctgggctaggcttcttcccaaactcagtttccag

SEQ ID NO: 392744 - DNA, 403 bp, Homo sapiens
ccctggagctcctccttgtgctgtgtgctcttgttcccttctaaagagagggggaattcaaaggagaaccagctgcctacagctctgggttttcctcctctcagcctttcctcagtagctaagccagacagaagcagagaaaaaaggccccagccccctcgcctccaagttgccttctcctgacagccagcaatgtggaacggatcccaaggggtaacagggcagggcaataattaattatgcccccccaccgccccgccgccttccagctctgagttgaatctcaaacccctgcccttcagtggctgaggcagcccagctgtccgccgccgggtctatggaaggtcattgaaaccatgtctctgcatccctaactcagcagatctgcttctggtgtcctacg

SEQ ID NO: 392745 - DNA, 311 bp, Homo sapiens
acaatgtctgtttcccaatggcaaatccctgcttgttccctcacctatttctataatgtattgtcatttataacctctgacagttgtgccacatttcccacattacacagaaaccaagcacagtaattttggaaggttttgtactagaaattggattcctgaagaaaagataacctcattttttagtcagtacagctaactcatgaaaaatgacttagtttccatatactacttttcaatgtaaaagaaaatttttaaaatatttatgacttcaacaaatcttggtcagaagagtttttatcataattctt

SEQ ID NO: 392746 - DNA, 417 bp, Homo sapiens
cgtctagaggatcccttcttgtgcggcagatacaggctgcagggtaggcagctttctgattttgtgatatctgtgagtagccacttgaaggaaattaatatcgttcactggagaggcagactctaacaaaaatataacaattgcatatttgacaaagatcaggtttttttttttaacggatggcttggttgatttgatctagggtaacacagcggcatcacagagggcatgcgctctggagtctgacacaccctggtttgttttctagctctgccatgtgcaactaaaaacaactggatgtcatctctgtcagctgtagcagtgaggcctcatgagatgagaggtttgtacaccctctagcacagtgcccagcacttggtgagccgaggctattagcactgctcagacttaagacca

SEQ ID NO: 392747 - DNA, 415 bp, Homo sapiens
cttatataaaattacatagtacagttatccatctgtatctgtgggttctgcctctgtgtacatggagggctgactgtactgtaattatcttggagataaaaagtgttatgagttcctttctaagaagtttggaattgctgttttaaaattccttatattgactttaaagttaccattacttgttaaagactaataattaacatgtactaagcatgtactgtatgccaagcactgttgcaagttctttacatgtattatcttagtttaccttatgagaaaggtagtactgttttcatttttagagaaggggaaaccaagctacacagaggttgaataacacagaggttgaatagctagagtgtggtagagccactctgactccagaacccaggcttaacaggggactcacaaccaa

SEQ ID NO: 392748 - DNA, 623 bp, Homo sapiens
tctaatacttagcttttaggtatttgcttcagtagtccactttatgtgttagtgttcgacattactagtgggattttgcttctcatgctctattttctgatttctatcaccagtggtttcatagttgtatacagtaatctctggttagagacagaggcagtggcctgctggggaacacaccagacggaaagtgagagttccttgttttgggctttactttgcccttgacttccagtaatcagggtgtttccttgttctgaaacacgcttgtgttagtcacaacaggttcacaactggcagacaggtaatccctgaacaagtaaatcccagtggaaccagaaaactgggtcttgttttccttaattggaacctgacttagaatcagctattgaactgggaaacaaacaaaaaataagtgttagccattagaaaatgaatttaaattactggtctgtccctatttagaatttcttgcaatcatttccactgtatgtaacactgaaatcctttgtggttgtctgctgcaaaagtgaatctttgacccagcaactttaaatgcttttgacaccattgggaattttgagaattgttaatttaatctgcacttgtcctaggtgggggtg

SEQ ID NO: 392749 - DNA, 328 bp, Homo sapiens
agacaaggtctcactctgtcacccaggctggagtacagtgtcatgacactgcagcctcaacttgccaggagaatggcatgaacccgggaggcggaacttgcagtgagccgagatcacaccactgcactctagcctgggcgacagagtgagactccatctcaaaaaaaaaaaaaaacaaaaaaaattgacccattcttgcaacagtttcccttccctgtcctttgaaggtatgggcatatactttttctacatattttataaatcccacataaatgcatattatttttgcttcagacagtcaagtctttaaagaaattttaaaaaaaaa

SEQ ID NO: 392750 - DNA, 666 bp, Homo sapiens
atggcagccatcttaccttccatcagaggagcctcaccgtacccaggaagaaagaaggtgaaagaggaatgtgaaacaggtggctgggacccagaaaccctcttaccctgcacctctgtcatacttctcccggggcatagggagagttattctgcttctctttgccttgttttgtaacatggggtagttgttggtgcagccatgttgtgctgagtgaacatatattaagatctttggaacctttaggagactgaaaataggtaagtatgaattagtatttctggaatggtattcagagaacttcgtaccatttttataaatgtgaaaggtaacctaattagaacagcttggcacttgtcagtacactactagatttcaaaatcagattctacttacagggagaaaaaaaaagcccaatatgttgaacagtattgaaattgttgcataaataaaagtccatcattgtagaccagcttactgaagtgaagaaagaaaaaaagtatatctttgtcttgaaggagtagatagtgacatgtcatgtttctttcaggatatttaggatctggcctaattcaaaagaatatttactgaatgcctatgttactgctgctgctgtcacatttacatgaaaataaaatgtaaattattttatttctatcaaataag

SEQ ID NO: 392751 - DNA, 617 bp, Homo sapiens
agttgaagacactcccatgagcactagatatgaatgtgggtggataggccatgacagcaaatggccctgcctttattacctgactcacttgtaccacaatagtcccaacatcactcactcctcatttattctttagggaactatttgaactctttcagaagacggactcctcgataaagcagtagtactcctgtttccaacatttcacattattaaatgaaaatgcaaggaacgaagaagggaaggagagaaagttggaggaggaggaatgcatggaagaagagaagacgaaaagaagaaaaataccttctcactcccacttctgcaaaatccactccaagcaatagtagtagagtaacaactcagctgaaaagtggtagcaagcaagactaaaattttaacatatacagcaataacactgacatctgtctgtcttagcccaagtatgaaattacagaacttagcagacatgtttaaatcttacactcttacatactttttccacaaattaaaaggataatattgtttgtgttagcttacatgggatacacataaaattagatattaggttattagtgacaattaattgaattgtttaaaataaagaaacttctgat

SEQ ID NO: 392752 - DNA, 153 bp, Homo sapiens
  misc_feature (111)..(111): n is a, c, g, or t
  misc_feature (116)..(116): n is a, c, g, or t
  misc_feature (137)..(137): n is a, c, g, or t
acaagtgcaaccaacctgcttctccagagatctcccaagacatcaacaatggggtcaaggaaaacagacacccttagggtcttctccacttagctccctttggtgacaggnctggncagcagcagcaggggatggtnagaaagaagcagctct

SEQ ID NO: 392753 - DNA, 364 bp, Homo sapiens
ctcatggattaaaggaattggtgcttaatttttttagctacagaagtgactgtcagagaaaaatacttcttaatcctttcatttaaacatttttttggcgattttttgaaggcaaaaaatgtgatacttctctttggtgttggaatccctagctatatttcagaaaggcactttccaatagatgttgatggtagaactgtcatttctctgtttttggatctaaatttagattatagcatgtctgtaagatttcctgtcagctgaaatggaaaactattagcttaatattcctcctaggactttatccttatacgaatgatagctgtgcctgagtcttggccttactttcagtttcccagtctct

SEQ ID NO: 392754 - DNA, 745 bp, Homo sapiens
gcagccccttataaaaccatcagatctcctgagaactcactcactctcacgagaacagcatggagaaaccacccccatgattcaattatctccacctggtcccacccttgacacctgataattattacagttcaaggtgagatttgggtgaggacacagagccaaaccatatcaatcaggttgctttgacatcagaaaacaataaatataattaggagaattaacattttttctttaatagaaaaatatatgatcatttcaagagatacaaaaaaatgtaaagttcaacagccattcaagataaaaacagctaggcaagctaggagtccaagggaactttcttttaagagacactagatagccacaaaaaattacagaaaaatcttacttgtctcaatacttgaaatacggaaagctttcctttcctgtaagaagcaagcccatggtcccagctgtcatcactgctacccagcattgactatgaagtcccaggcagtacagcaagacacaaacaagaaaaaaaaggtataaggatcaaaaaggaagaaattttcaaacatcacctttcacagatgatatgatcatataggtagaaaacctaaaataatctaacataaattattcccagtagctaaacattaagaaatatgtaatcccagcagtttgggaggctgaggcggtcggatcacctgaggtcatgagttcgagaccaacctgaccaacaaggagaaaccctgtctctact

SEQ ID NO: 392755 - DNA, 608 bp, Homo sapiens
tcggtacccctctgacgagttccccaagaggaaggtcctccattcagtcagttgagggggtttagaatttcatttttggtttacaccaattagagttcatgtgagagttctgaaatgaaacctcaccttggagaatgagtagaatttagtcagacttagctttggttctgccattttgttttggcttcctttcacatgaagacgggccattgtcctgtttgctcttgttccttggctggtttcaatgttagcattgcccttacagactgggcagaagagtagacagacttttctttgggtattcaaaatatcaccatcaagtactgttaacgtgcttttttagactggaaactttcccaaggccgttttccccacccactgacttgcctttagccatgatcatcattgcttttgtcctgtctgtaagaataaaaagaaaaagtccttttaatgtaaaagtcataaaccatgtcctgacaactgcagagaattatattgctcatttgtttttattgttagtataacttttaattgtcttccttatctttgtgcctgactgttgtttgctggctgaagttaactatgttttgaaagtcagttcagaggtg

SEQ ID NO: 392756 - DNA, 391 bp, Homo sapiens
caaagcatctgttttctcagtcttaagatttctgtttgaatgttaatgcatgccggccagtcgtgcccgaattccaaagggaggagggtagaatgaggtgtgtccgatcctcccttcccatcatgccctgcactagtctttcaggttaactttggaatccccttggccaagaggaaggtcctccattcagtcagttgagggggtttagaatttcatttttggtttacaccaattagagttcatgtgagagttctgaaatgaaacctcaccttggagaatgagtagaatttagtcagacttagctttggttctgccattttgttttggcttcctttcacatgaagacgggccattgtcctgtttgctcttgttccttggctggtttcaatgt

SEQ ID NO: 392757 - DNA, 431 bp, Homo sapiens
ccctcctgctctccttcctccctcctctcttctccctcagctctgcaaattggtgaccccccgcaacccggggcccatagaggctggaatggagtctggagaccgcagctccaccctgcctctccgtcactgaacgtgtgaccttggggaagccctttagctcctggagagccggagccacctaagagtgcattcgatttaaggacgcatctcctctctgctcaacaaagagggaggggttcctgcacacgttggatttctgccctcatggagcttacagattcattagagcattccagaaaatgtgaagacttggggaacttgagattctagagtggcagagtgatttacatgccactgagcggctgggtgccgatgaatagcgaggtgccgataaatagcgaggtgccgataaatagcgaggtgccgat

SEQ ID NO: 392758 - DNA, 314 bp, Homo sapiens
ccaaagtgcagggattacagctgtgagccaccatccctggcatatttttgtaaatttatataaactgtttgttttccataaactaggatcatgctgtatatattgttctatttactgactttccaactcatcaaaatgtcttggagagctctgtctgcacctgcaaatctctcccagggcttggcacactatggtccttgggctgaattaggcccacagcctgtatttgtaaattttttttttttttttttttttttttttaagggaaaccacttattttaatagagacaggggggggcggggaggggggggga

SEQ ID NO: 392759 - DNA, 290 bp, Homo sapiens
aggtggggacctttttgggggtgattaggtcatgagagcaaagccttcatgaataggattagtgcccttataaaagacgcctgagagagactattcttcttccaccctgtgaggatgcagtgagaaggtgccagctatgagctaggaatctgaccctcaccagacatcaaatctactggtgccttgatcttggacttcccagcctccagaactgtgagaaatacatttctgttgtttataaactgctcagtttatggtactttgttatagcagcccaaacagactaagac

SEQ ID NO: 392760 - DNA, 412 bp, Homo sapiens
gaaagcaggttgagttcgggtcgagctgtgcgccttttttcctctcgctctctcggttatcataaccttgtattccctctggaaggaaatggaaattcctttggatcatcttctaggtaaacagtttaattagctgcgtgaggtgacaaacctgctcggatgaagtcatgggagctgaacgaattggcctgaatcccaagaggggagtgttcagggcgcgcgtgtccctcggagaggctgaggtaacgctggctccttcccgggagtccctgaacgcccggctttggaatctgcagacagctcttctagcagggcgttggcacctactgactaaccgtgcaatcactcagcagctgtgatggttggtgacatgtctttcacagcccaagatagcctccctagactgagcaaa

SEQ ID NO: 392761 - DNA, 374 bp, Homo sapiens
ccctgagggctttaggctgagattgcaagagctctcagtgtttgcctttcagaatgagacctactgagccctcttcaaggacctgaagcttcctgctgaggtggagcaccagcccgcaaagagttacaaaaacctcaagaaccccctgcatttcttttgaaatcaaatatttgtgaagttggggagagtttctctggaaagttctggatgtagttgagagctcagagaccctaaggctggaagttggagctctgactgccatctttgggttgggctgaacagcccaacagggccagggaggtgcctcgggagagttgactgctcctcatcccccttcccctcctaacacacacacaaaaaaacattcagaagtg

SEQ ID NO: 392762 - DNA, 727 bp, Homo sapiens
gaatatatgaaattatctctgagaatgtaaaagttaattggctaggaaatgtattgctggacagtgtgaaggatccccttgagatttgggttatcagtttaaaaggagactagccaatgctgttaccagttttctatccatgtttagcttcttgggttcatatgcaaagtaggcagagagttaggatataactagcatctttacctggtgagtacaagggatgagagtagtaaggaagacagtgatgtatattaaggagtatttatagtgatggaccacataagctgtgtaaacgagaccaccaaaggaattagggtgctataaatcagtgtaacaaatggattgaggatcctgttagaatcagaattgctggagccagagtaaaaagtcagtgagttggaaaaatagaaggtggtgatcagacaataggatgtaagctttttgaggtcagggatttttgtttgtttgttcattgctgtatctctataatgcctggccatattcagggttcaatatatgtgtgtcacatgaattaatatgatattttaaagtgagattttggagttggtgcaatttttggtaatgccaaggagtagagtataacaaagtggttgagtgactaaggcgagaaggagaaaaaaaataattgaacgtgatgaggtcatggagtctcagccataaggatgttaaagtcactgaagtaatttttttaaaaaacagagataag

SEQ ID NO: 392763 - DNA, 175 bp, Homo sapiens
atctgggggctgagaaggacatcaggggatctgtagccaggagctcaaggtcacctgagggctgccttggctactgggggctcctgggaagccagtatcagactaatcctatcggattgggaacaggcttcccactggagtgctggcaggagtagctccctgcttgctggcagaa

SEQ ID NO: 392764 - DNA, 164 bp, Homo sapiens
gggtttctaattttcaagaagctggaaacctgaatttttttgtttaagtctcctgacttttgcatgaaatattattatatttaaatgttgaaactagtttaactctaaaagacaagacaagcccatgtgaagcaaactgggcagagcatggatgagtgtcctat

SEQ ID NO: 392765 - DNA, 166 bp, Homo sapiens
atgttggtcaggctagtctcaaactcctgacctcgtgatccgcctgccttggcctccaaaatgctggaattacaggtgtgagccaccatgcccagccctacactgtggactggtatctttatgaaactctccccttcctaacctttgtggcatagtttccttctgg

SEQ ID NO: 392766 - DNA, 107 bp, Homo sapiens
tttccaccccctaagtgatggagatggggtgtctgcacccctgagcgatggagagagggtgtctacacccctgagcggtggagagagggtgtctacacccctgagcg

SEQ ID NO: 392767 - DNA, 276 bp, Homo sapiens
cataattgcaataaattgaccatttctacctcctttggctgagccctggaccttccatgtcttcactttggattaattgtgattttcctgcctcgtttctatgttattttttctaatttctgaaaaataactttgaagtcagtttctgagaagtggcttttttttttccattttacattttacatggtgctgttttaatgacaatattacttttgctagctgtgtgatgtctctgtgctgtaaaaaagtatcccagggatctgacagacaattagg

SEQ ID NO: 392768 - DNA, 497 bp, Homo sapiens
  misc_feature (29)..(29): n is a, c, g, or t
  misc_feature (31)..(31): n is a, c, g, or t
gtcatagctgactcctgagggtaaaactncntcagcgagagaggagagtaagtgggacagagctggccacgttctaaggcgggatctgggaactgaggagaaaggctactgcgaaacgccctgcaaccaaaggactgggaggaaacagaactatcaaaagacagagttgaaggcccttagcctccagaatattctgccatgaccccatatccttcctagggttggattttggaaaaatcaagtaaagggggctctgtttcataagaggttggtgcgtggagaagaaagaggaattgattgacgaatgtgagtcggaacttaccccagaaatggtcacaagagggaataaataatacaggggtggcagctggagggtgatttgcttagacaatattaacttaattttcaaagtcaggggctcctcaagttgtttttgaatattactgtcacagtaatcaagaacgtaatatagaagtcatctctgcatttcatttttc

SEQ ID NO: 392769 - DNA, 315 bp, Homo sapiens
tgtgcagtgtccccaacggctgcactgcagcttccaggcaacaaacgtcagacctcaaaacagaggaacacgaaaatacatttgaaaagagactccacagggagatgaaaacgttaaaaaataaatcaacaggccgggcgcccatggctcacgcctgtaatcccagcactttgggaggccaaggcaggcggatcacctaaggtcaggagttcgggaccagtctggccaacatggtgaaaccccgtctctcctaaacgtacaaaaaaattagccgggcatggtggtgggcacctgtaacctcaattacttgggagg

SEQ ID NO: 392770 - DNA, 603 bp, Homo sapiens
atagtttgttagtagcagctggccgggtgcggtggctcacgcctgcaatcccagcactttgggaggccaaggcaggtggatcacgaggtcaggagatcgagaccatcctggctaacacggtgaaacccggtctccactaaaaaatacaaaaaaattagccaggcgtggtggtgggcgcctgtagtccctgctacttcggaggctgaggcaggagaatggcgtgaacccaggaggtggagcttgcagtgagctgagattgggccactacactccagcctgggcgacagagcaagactctgtctcaaaataaataaataaaataaataaagataaataaaatttgttagtagcagctgatattctctaatttctcaaaaatatttctcatactggcaaaaataattctggatgtaaaatctaagagggttttacagaatctcacctctcgagggcacaagtaaacatacccattaccaaagataacagtaaatttagaattaaaaaataacttgaaatatggaaaaagttttaaagaatctgctgtttatcactgttacttaatggagaccagatgaccaaaaaaaaaaaagtttcaaaaagaat

SEQ ID NO: 392771 - DNA, 276 bp, Homo sapiens
gaaaacaaatccatttacaatagcattaaaaaggataaaatactaaggaataaacttccttgtgggcataaggaataaacaaaagaagtgtaagacttatatactgaaaactgtaaaacattgttgaaagaaattaaagatgatctaaataaatagaaaaacatcctatttcatgggggctggaacacttattattattgagatggcaatactctgcacattgaattacagattcacagcaaatcctgccaaaatcccagcggccatttttttttt

SEQ ID NO: 392772 - DNA, 510 bp, Homo sapiens
cactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccaggtggaatggctgtgaaggaagggggcaggcgagccaccaggtagccagatcttctaagcacagcaggtttgagttcgtctgatgtgtggaaagagccctgcatctttgacaatgtgactggcacaggcacgtggttggatttttctgcagaaaccacacctgtgtgtcaccagctgtgggga

SEQ ID NO: 392773 - DNA, 794 bp, Homo sapiens
cactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagacggagtctcgctctatcgcccagactggagtgcgatggcgcgatcttggatggtgccatctcagctcactgcaacctcggcctcccggtttcagcggttctcctgcctcagcctcccgagtagctgggacttcaggcacacaccaccacacccacctcatttttttgtatttttagtagagatgaggtttcacccttttggccaggctggtctcgaactcctaacctcaagtgatccaccctccttggcctcccaaagtgctgggattacaggtgtgagccaccgcgcccggcccacatctctgcattttaaaaaatgtttcaggagatcagtgtagctcaggtctgcccttgagagaaaacactatttcaggatgttttcacatggtcttcctgtccctttttaagttgttgaaatgtgttatgtttccttggagaagacaaaaatggagctatgatgttgctt

SEQ ID NO: 392774 - DNA, 789 bp, Homo sapiens
ctgcttcctgacatggcagctggcttcccccagaacaagatggaagctacagtgtctcttatgacctaccctagaaaggtatttcttatttttgctactttctatttactagaaacaaatcacaaagtccagctgcattcaaggcaagaattacgctctacttctagaagggaggaatatcaaacaattgtggacatgcaatcatgtaccacttaacaacaggaatatgttctgagaaatgtgtcattagacaattttgtcactgtgtgaccatcagaaaatgtactcacacaaacctagatgggatagcctgctacacacctatgctatatgacacaccctattgctcctaggctacaaagctgtatcgcatgctactgtattgaatactgtaggcaactgtaacacaatggtaagtatttgtgtatctaaacatagaaaaggtacagtaaaaatatgttgttataatcttatggggccaccattgtatacaaggtctatcattgacagaaacatcattatgcagcccatgactgtattttgaaatacacacaggtgacctgtggcatactcagaaaaagatatgtaatttattcctgcataggaaagttaatttcacaaatacacacacaggcacacatacagacatataaagagacaacttaagcagcaaaaatcctcaataggcatgatatgccagccacaaaaggtaacacaattctgggttggaataaaaaaaaatggcacccagaacaagttccatgatactctgtcccacttagactacat

SEQ ID NO: 392775 - DNA, 190 bp, Homo sapiens
cctataatcccagcactttgggagatcaagatggtgggatcgcttgaacccaggaatttggggcttcagagagctatgagcatgccactgcactccagcctaggtgacagagaaagatcccctctctaaaaaaacaacaagtgaaattacaaagtagctcacatggaatgaaaaggaagacacacgtatg

SEQ ID NO: 392776 - DNA, 407 bp, Homo sapiens
tccaagggaactgattggagaggcccttccccaaggctcctattctagccccgaacaaagcctaatttgtaggtctgtgtgcagacatatgctgggacagccaggcacacagcctagagtttggctcaaattccttccttctgcctgggatgtgggggtggggaggagagtccactccctgcacatccttttccggcaccagagcaggcaagagttagacttcccgggttccagtccctcttcacacttccttatctgtgtggctttgagtgaagtccttctctctgagcctgtttccgcatctgtaaaacgggaataattaatgccatttctcagggtggttgctgagagacagtatgtaaaaggcttagaaaagtgtctgtcccaaagctgttatcgatgctgtt

SEQ ID NO: 392777 - DNA, 437 bp, Homo sapiens
taagaatgtcatttccatttaaattgttttacagactcagcacatattcaagttaaatcccaccaggattcttgtaagccaccgctctttacaatgttttaagaaactatattccagctccaggcgggagctatagttgcagctcttcattcctgaaccccgcaacaaaggcacacacctacttttattcaacttctccctctcttcaagcccagtgaagccctgaggcacttggggaaccctgtgagtggtgatggggagaaaagcaaatagaggaagtaggcctggatggttagaagcctctcgaatggtaatgggaacagaggtgctacagttggggataaattttttaagagctcaagacttaaggaatgatgcttccatttcatctgaaagggaggcagaattcacagacggggaaaggggttgggaaaaga

SEQ ID NO: 392778 - DNA, 401 bp, Homo sapiens
ttagcacaagcattgttctttgttctgtgggtgataattgctgaataataacaattatggcaacaaatggttaattaaatgaatgaatgatatagatccacacaggagtactatcaggtaaaaatagccttaacaccaagctgttttcataaagtagattcatttacagattttttattattgttagagaaagaacttcttttaatgaaaaaaatgttagatgatagccagtaaaacacatttaattgttaattctgggcttagaagaagaagatacagtaaacgggaatatcgccatacattttacaacaatcatttgaaaaggcagtcattttcccaagcagttcacatttgatcacctccattaaggacttcacacaagggaaccatggtatctttct

SEQ ID NO: 392779 - DNA, 422 bp, Homo sapiens
aggctaactttgggaggaatttcgttgacagtttaaccttaaagcaaggatgataatagccctttccaaaactaaactgcctttgtaaaactaatgaaaggccacaaggttaggattatgagaggtgtgtgaattctgctgaagatgtaggcatactttccataatcccttactattcaggagtcttgtggccagaggtcacaagattggtgccttccccaattgctcttacaaataccaacactattgtagaatgtaagattggtcttttgagaagttcttcagactgactccacctggacttttgggactcgactggtccaatggcccccacccagatgcagcctcagcacatgaggcctgttttccacactccatgactggatccccaatcaatcagcacccattccctagccccatgc

SEQ ID NO: 392780 - DNA, 476 bp, Homo sapiens
gagtatgtgtgtgtaagtgcactgtatgcatgcatgtgtgtgtgagtgcacaggtgactgcctgcctgcagctgcactagggaggaggcatgcagcagtctcggtggcccctcagtgcagctaagccactgaatcaggtccccagctacctacctggtggtttacctgcgacattcgcctgaatgagatacaaataccctcgcaaggatgcttagacttgtctcacgcaagaaatgccaaggtctgggttcatttgcatatttataataaaacttgcagttttcaaaagcacctactggtggctccactcttggaggtgcacaccccacatctcacctgtgagaccaaggagctgctatctgaacactcagaaaggagagcagcaggtggatgggggcggcagaggaacagcattcaaagtcccagcacccttcatcccatgacctgtgcacccaaaacccagaggcgggcatttg

SEQ ID NO: 392781 - DNA, 509 bp, Homo sapiens
tgactcacggcagattcactgggtaatgggtgtgttcttaaggcaacgcaaccacccagcaacacgtcttttttaggaagccctggccagccagggtatctctaggttgtcctggtttagcattgcctcctagccggagacttcttgaggctgactaaaggttgctggaagctttcttgcttcttcatccctcctacttcctcaggttctgcagccaggctccagtgcaggagaaattcagcttccctcgctcaacatcctgcttcctctctccaatcattaggtcaggtctggggagatgaaggatgtaggacacaagttggggtcaattaggggaagtcaaggagagtatggggcatgaggaatgcacaatagggatattggggagagctggaaacaaaagaccaccagattgagtagcctagtctcccagtgctgactgagctagaaggcaaggctcaactggcagtgggaagagaagtgagttcagacatgccaggctgtcctta

SEQ ID NO: 392782 - DNA, 568 bp, Homo sapiens
  misc_feature (384)..(384): n is a, c, g, or t
  misc_feature (396)..(397): n is a, c, g, or t
  misc_feature (408)..(408): n is a, c, g, or t
  misc_feature (436)..(436): n is a, c, g, or t
  misc_feature (454)..(454): n is a, c, g, or t
tgtggagatggggtttcaccatgttgcgcaggctggtctcaaacttgtgagttcaagtgatctgcctgcctcggcatcccaaagtggggctattcatcttaatgacaccattgagtacaatctctgtgtacgtggatgcgataatttgtgtagcaggatttaccctaaggttctcaggcagaaaggaagctcccttctcaaaatgacaaaatgtagagtattctaatctagagcttcgtttcattctggcagttctagcctaggcctggcagatgcttcattaatttagaaagttattttcaaaatattttttaaattctgttttaaatttatagaaatattatttgttcattgtaaaattcaaaaactagagagagagagagngctcctttcccnnccccccctccntttccttccccctcctcccactcccatnttcttacttcctttctcnaccccctccacttccttctttaattttccttcctcactctcctcccaatatcccaacatcttctccttttaccttttcattccattcctccaccctaccttcctattttcctcc

SEQ ID NO: 392783 - DNA, 401 bp, Homo sapiens
tgtggagatggggtttcaccatgttgcgcaggctggtctcaaacttgtgagttcaagtgatctgcctgcctcggcatcccaaagtggggctattcatcttaatgacaccattgagtacaatctctgtgtacgtggatgcgataatttgtgtagcaggatttaccctaaggttctcaggcagaaaggaagctcccttctcaaaatgacaaaatgtagagtattctaatctagagcttcgtttcatttcaaaatattttttaaattctgttttaaatttatagaaatattatttgttcattgtaaaattcaaaaacttagaacggtgagagagagagagagagagagagagcatgagagagagagagagagagagagagagagagagagagagagagagagag

SEQ ID NO: 392784 - DNA, 500 bp, Homo sapiens
tcttcaagaggcggcgcagctatacctgggaccagttttaagcccagtaaatcaagactgtctggagtgaacttcctcagctacctgccccccaaatgtaaaaactcatctggttgcattcacccctcttcctcccctccagtactaaaggaagaggtgtcgcctctttccaaggtctctccctgatctggctaaagcccctgatttcctcaggttcatttctcaccatctcctagctctcccgtgtttttcatctctgtttctttactggctcattctcctgactgtgatcatgttcagatttcttaatgtgtaaagaaacaaagtagcatcctccatcttctgtactcccataaatgaattaccaattgctaaatccagggggctctccaggcttcacctcacttgacatttccttagcatttgattcagctgaggactttcttcttggacgtctctttcctcagcttccaaaagcccactccctactatagcggttg

SEQ ID NO: 392785 - DNA, 170 bp, Homo sapiens
gtgcgtggcgtgtatgcatgtgggggtatgagtgtgcatgtgtgggttgtgtgcatgtgtggggtgtgtgcacgtgtgcatgtgtgtgcatgtgggtgtgagtgtgggcatgtgtggagcctgtgcacgtgtgtatgcgtgtgtggctggtgtgcacgtgtatgtgtgta

SEQ ID NO: 392786 - DNA, 379 bp, Homo sapiens
ggagctcagacatgtcgagagggagagggctgtggcccccaggtaggaccatggggcctaccacagttttgtgatgggggctcgttcaggtggttttcaagaggcattgagtaacatgggtgtgtcctggaggtacagcgcctcaggggctggcttgaggggctgtggacagaccctttgggtggacacgagcccttctctcctggatctctcccatcaagtcctaaaatctcgttcttccatcatttccttacttacaaagttcaggagactcattgtctactgggggaaaaaaatcaagctatgccgaaggctgactctatggctttgtaggggggccttgcagggtcaggacccatgccctcctctaggccacgtc

SEQ ID NO: 392787 - DNA, 307 bp, Homo sapiens
ctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagt

SEQ ID NO: 392788 - DNA, 209 bp, Homo sapiens
agagataaatatttatctctaggcttaggcttacagttccaatcaaagtttatatgtcaataataacaataacaaagccattttttccttggaataattctattcaattcttcctccttgcaatcaaatagatagatgcaaacattgctactgctatcatttgtattaagagaaaactgacttgtcaatagtgtcaacccaaatatgaa

SEQ ID NO: 392789 - DNA, 130 bp, Homo sapiens
cagaaattctactgtgtttgaacagattggttaaatgataccttgaagaagacactattgcaaaacaaaaagttatgtagaaataacattctcagcaaagtgtgaaacagacagtgaatttataacctta

SEQ ID NO: 392790 - DNA, 441 bp, Homo sapiens
acatttgctaggtggagaatgggactttatgggagaaaacagcgaagatggcccagttatccagggagaaatggtggtggcttggactagaggtgggagcagtaaagatgatggatttcagattcaggtggtgaagcccccagacaacatggtgatgggaggtgcgggattaggagtcccaggtaaatcctgagttttgtttgggacaggacaaaatctgcagttttaagtttagaatgccaaccagatagatattttaagatgaaaaaagctaaacaggcatggttgctcatgcctatgattccagggctttggaaggctgaggtgggaggagacttgagcccaggagttcaaggttacagtgagctatgatagcaccactgcactccagcctgggagacagagctgtcgccccatctctaaaaataaaaaaaatatatt

SEQ ID NO: 392791 - DNA, 673 bp, Homo sapiens
aagggaaggagggaagagtagtagggctgtgggtgaaaggctcgtgaacaaccccctgatgagcattttctttcctccttgaaaccctgtggcatgagattaggactgcaaagtaacccaaccctttccatgcaaagtaacccaactctgataatttgccaggctggtaactggtgaatgtagggcttggatcttctgcttctcactcaggtctttctgtctcattacaccctgtgggagagtcaggtcccccagttcagggcccagggccatagcaagatgcctctgggggccagggtccggagctaggcaggcccctggtttcctggaaattaggaccctgagcctcccttttcatggcaacttggtcttagccttcaagagccatatctgagctggtgtagaccgggctcagggctaggagaggcaccatctagcaccagcgtctccacttgcctgctcctccttgtccaaatcctctgatcgtccaaaagctatttgatttcccaatgattaacccagctaagaggggagctctcaacaggcccaaagagcagatggagctgaaaggaacccacccctgcctccgtggagccatgggccccgggaagggttcccagcacataactctcctgccctgcacaaatcctaggagcgccagccctccctcccc

SEQ ID NO: 392792 - DNA, 421 bp, Homo sapiens
tcagagcaggacctaaggtggacttgaaagccgtcctcaagctgaacacagatgaaacagtaaagaagaggagcctcactggcactaggggtttaagcacaacctctaaccaaccactggctgaacgatgttactctgacccaggggcacctcctgggaaccaggcttaaaaatgaaatcacatacatccttggcaatctaggagactgtgtacatgttcaatgctatgctacctccagggtgattgaagagggaaaatctaagctattagtacctggctgaatgtgggacagaagcatactcttgaactttggtagtaacctccaagtctcgcacacactcaatggaaaagggtaaaaatctaaccagctgaagggacttaagcacaacctttaactaataagtggcctgtgccaaacca

SEQ ID NO: 392793 - DNA, 426 bp, Homo sapiens
aggctttgttttctacccaggattaatcattcactcatgggctttaatacaagccagacacaacctcactgtgcaaagcaatgccagctccccttccattctgatgctagcttttacattcttgttgtcagagtgggaactaggtttttgccccagtttcagaatcctatgaagtgaaaagtttagaaacttccatccaaggatgttagtcaaaaatgccaggacagctggactcagccattaatttgccatatgacttgcggccatttatttcccatatctgggctttagtatccatcccacaatgagaaacttggagtaagtgatattcaaagtcatccagctctgatttctacatatttgtgtttccttcttgagctaagctctgtgtatacgaagtcagtctccaaaaattttaagcagaga

SEQ ID NO: 392794 - DNA, 756 bp, Homo sapiens
aggaagttaagaacagtcctaaaatctctttggcttctttgtcctgatatgcaccggcattttcacagtaggaactagggtttctgtccagtttttttggttctttaaggaattaatgttattctgggtacaactgcttacatacatagcacatatagatgacatttttacaggccgtcttgttagactgacatacatggaggatagtgccacccgcctcacaagaacatcaggtaagctcaggcacagagtgcccaggaatctgtaaggcttcgcccacgcacaagtcagggctgccagtcacctgggttgtcttcactttatttggctgcgtctaatgacaccttccaacttttgaccccacccctggactgttgtgtaaacattgtatttctccatctgtaatgaaaaagctaacacatctctaactccagagacattttccagaacatgctgttctcaggcactagtgaggcggtaccattattcctcatttgttatccaaatgttggccatgtgaccacaccaaaagctcatcctgggccactgagactggtaattgaatcagaatatagtgaaatattcattctcatatatacccagccatcttacatctttggcttttttcagcagatccttgtggcactcagaacatccattttgcactgtgtatttttttcccttctgtgtatcctgctttgtaaagagtcacgagtggttttacaaataaagcctgttcttactcagaaaataggt

SEQ ID NO: 392795 - DNA, 676 bp, Homo sapiens
attcttaagttcgtggggctacaatttcctcatctgtccagacaggataataacatctacattttgtagttttgagaggattcgttgagatgacgcataaaatgcctgccaaaagatgtctcattgagtcttcccgctacctgtttatcttcctgacttagataatatttctaaggggactgtctttcttctcctctatctcagtggtggcttctgttgcttcactgtttgccagtacaaattttccctgtcactctctgttttatctggtcaacagcatgcatttcccccttggtcttctgataaggtatgtttaatgtaaaattttaactagtggttctgtattttaccagcttcttttgcttaaatttgagtgaaccacatgctgaatttttaagcagctttccttctatagcccataagtgagattaagtatgtgatacctgttgttattccatcttttatcaatcgttacttcccaattgctattcccatatttacgtcagaataaagtgtcatatttttcccttcatatagaattgaaaatttagtgttgtttaataccaaacaaatacttttctgcacgtctttctatagaagatttttgttccctgctcaacagtctgtatttggctgcaaggacattcactgagtacccgtcgtatatgactcactc

SEQ ID NO: 392796 - DNA, 626 bp, Homo sapiens
tcaattccattttgaagacaccaaaaataaaatcctttgaagaaatttaacagaaaatgtagaaaactcattgtattagtctgttttcatgatgctaataaagacacaatccttatcaaaattctaattgacttctttgtagaaattggcaagctgatcctgaaatgtatatagaaattcaaaacacctagactagcaaaagcaatttcgacaaagaataacaaagttggagaactcatactttccaatttcaaaatttactgcaaagctatagttatcaggactgtgtgttaatggaataaagatagacatatagataaatagaggtaagaatccaggccaggcgagatagctcatgcctgtaatcctggcactttgagagttcaaggcaggtggatcacttgaggtcaggagttcaagaccagcctggccaacatagcgaaaccctgtctctaataaaaaaaaaaaatacaaaaattagctagacatggtggcgcaaacctttaatcccagctacttgggaagctgaggcaggagaatcacttgaagctgggaggtggaggttgcagtgggccgagatcatgccactgcactccagcctgggggacagagtgagactccatctc

SEQ ID NO: 392797 - DNA, 464 bp, Homo sapiens
ttgatagtcattgtcactggcatcttatctgttttttcttgtttctgggctctgctcctctggaccaagccatgttcttgtaaaggttttggagaaaggtgtgcgattgtgcctggaattggactggtgggctatgaggaagtgaggagagggtggtatccaggatgaggcctttctctttgacctgtgggagttgggatagtgtggctttccctgagatggcaccatgggtagaggagtaggtttgtgggaagacagggagggcagtccagagcacatgggaggtgtccaggaggctgctggtcagccaggtctgacaatcaggagagagactgagcctggaaacagaagtgtgcctcactagtatgagatgcagggggaggcctgctggacagccagggctggatgtcaagagagaatcagggcggtagacaaggagttcgtgtgaatactggggacggaca

SEQ ID NO: 392798 - DNA, 322 bp, Homo sapiens
aagcatttgtaaaccatgcttttgtatcattaggtaaatataaaatatactataagttaacaaaactatggaatgacctgtttagtcacgaaagacaacacagtacacaattccatttatataaaatgtccagaatcagcaaatctagagaaaggagtagtttagcggttgcctagggctggggtggtggggaagaatagggatgactactgctaatgggtttagaacttctttttgagacgtgttttaaaattagattgtggagatggctgcacaattctgcaagtaaaatgaaaactatgagatgtataaacatgccata

SEQ ID NO: 392799 - DNA, 337 bp, Homo sapiens
ctcagttaatcttcacaatggtccttggatgtgtatactatgattttcatcattttgaaggtgagtaaatggaggcttgaggagattaagtaatttgctcaaggtcatatgactgataaaggctggagcctgaatgattaactaattcctaactctactctattgtaaagtctgggactaacacagtttacttgccatcagtatttactgagccttgcactgggctgggccaagcactgtgttctgccctgctggggacaacagtacactattgagctctgccctagaaaagcccactgcagggggagagagaacacaggtccatcagcaaggaacc

SEQ ID NO: 392800 - DNA, 653 bp, Homo sapiens
aaaatcaattgtataatgggaaaatatttttcttagccagaatattaatttcctcatttaggtttttaaaacataacaaggtatcaaagaggccctctaaaatatttgagttttactttaaaagagtctcaactaccttttgtcaaaagagcacttttcttggagaaatacattcatctgtacttttatactagaacattattttttcatttatttggttagttcacaaatcccaatgatatgttgttaaacattttgatccaaaatgggtcaaagagagatactaactcactgtaaaaatgatctttaaaaaaaaatacagagactattatgaaccaatgaaatatatgttgttaaagttttttatatgtaccttccaaaataaattactaatttcagtgaatcaaaatttaagatttcctaattgttctcttaaaaacgtgtcatttacaatttttataaaaacattcaaatattgttccaaatgtcttcagcattagacttaatatttgtttcaaattccagataaagtcaacatgatgggctcggcacaattgctcttattttgtgttcatccgtacctacgatcttgatctatttaatatgattaaccagaactaaggtaagacccagaagaacagggtctatgccta

SEQ ID NO: 392801 - DNA, 482 bp, Homo sapiens
cgatatgcggtctcattcttcgggtctcacttaaatgttacttcctcagagcgaccttcccacctcttcccccaaggacagactctccaaccctaccctgttacatacagtgaccctgaacaacacaggttgaactgcatggatctacttatacccagattttttttcaatataaattacactgatggcaagcacagccccccaccttctgtctctctttctctctctctgtctgtctctctctctctctaatctctattttctctccacccctgcttctttgtctctatctctctggtgaacagcaaggagatccctaggtccccatctctgaatcccctggtgacctgaggagggtcccccagaacatgccttgggagggggaaccccctgagtgctgggaaccgccactccacgtgcacccggccccagcctctactccctacttctataattaacattttttagctcccacacatgag

SEQ ID NO: 392802 - DNA, 260 bp, Homo sapiens
attttaagactcccaagcccctttattataaagtttaagcacattcttttcctaaataactttggtaaccttcttaagaataggaactatctccaattcagttgcttccccagaaagttaaatcctaacatttgttttatttcctcctcccatccttccttctttaatctcaaaaggctaatttttccagagaacaatttaagtcttaatcattttaatttagtttccaacatcactgtatgtacattaacccaagaacc

SEQ ID NO: 392803 - DNA, 419 bp, Homo sapiens
ggggattaacccactggcacaagatggcacaaagagcaataagagatagggtctttggctaggcgcagtggttcacgcctgtaatcccagcactttgggaggctaaggcgggcggatcacctgaagttaggagttcaagaccagcctggccaacatggtgaaaccccatctctactaaaaatacaaaattagcagggtgtggtggtgcatgcctgtaatcccagctactcaggaggctgaggcaggagaatcacttgaaaccgaggggcagaggttgcagtgagctgagatcatgccattgcactccagcctgagtgacaagagcaaaacaccatccgaaaaaaaaagagatagagagagagagagagagagagagatagggattttgcatgtgcctgtgtgtctccagagctcatact

SEQ ID NO: 392804 - DNA, 129 bp, Homo sapiens
acaggagtttgaggccagcctgggaatcatagggagaacccatctattaaaaaataattgtcctaaatctactcatcctgtgtgctataaaggaacagcatggtttactgaatagtttaagccagttat

SEQ ID NO: 392805 - DNA, 110 bp, Homo sapiens
gggctgaagaggaaggaagctggaaacactgcatagggctacttcacaccaggactcattcttggcccccggtgaccccaggagaacgggcgagttaaactgtcaaggag

SEQ ID NO: 392806 - DNA, 834 bp, Homo sapiens
gacaaaactcagccccaactccagtagctgatgcaggggtggaatttcattctgcttcttccttactgttattttatgcaagggggtggagcgtgtgcgtgttggggacggaaaagtgggaaaggcaaatggtccgctggaccacagtggtcattgtatgggtcagaaatcaggttactcttagagaaagaaactattgagaatcaacccaaagggaattaaatgaacacctgtaaaggaatgtggggacttactaagcacggggctgagaagatgccatcaggcaagggtgattccgatagtcggaggaagctactccctgatatagcgaggactgaggctcacatgtcacaaccggtcatcgtaaagaccagcggtgctgctatacctcccacagtacatagaataaccccgtaaagaatgacctggctggggcctgagagcattgctttacctggaggtgcagccagtcagccaggggaacgaagcagtatttgtgggctgagcagagagggccctgggcagatcctgggtgtgtgcacatgagggccccgggcagggcagggcagaggaggttgggacactgagtcagaggtatgctcctgaaggcaacccacaagggggccagttcgtggaactgcaggcctgatcctgagcagcatggtgcggagctgtctggacaggcctgcagagaagggcgcctaccttactgaggtcaaccacacacatccagtagccacaaggctgctgtcgcaaggcggtgcctggcctatcttgtgatgatgtttgtttttacacataatgttatgctttgcttatggacaagcaatggag

SEQ ID NO: 392807 - DNA, 432 bp, Homo sapiens
cacaccaggaacaaaagaataaatacatacagcttaatagatgcatcagtgatgtctaatgagggcagcagccatccattaaataaaaaaaaattactctgagagcagacataatcaactaattgagcaatgatgaacattaatagtttacagttatagttatttactatagttataattaatcggcaaattattaacattaatatagaaaatatacataaaaactggatgaaaaagagagaaataagcagatatagagggctacacattaagttaacacccagatccaggtacctgctttaagatcatgcctgcaatgtccagatgctctcaggaagtgatactgtacacaaaggtactcaagaaaaatgtcttcctcataccaagaaggcagtgtcctctacgtttgatgcttcatttggaataactttt

SEQ ID NO: 392808 - DNA, 220 bp, Homo sapiens
acacaacctgttgcacagaaattttagttttctactggatggagctttctcctgttagttaaaatttcttctcatcagagttgcttttttttggcagagactctgataccaaattgccacccttcttaaagcttcctgccaaactagtccttctgccatgggatggctcacttgggggcagccatccattttgtggttctggataaggtccttccacgtt

SEQ ID NO: 392809 - DNA, 415 bp, Homo sapiens
atgctatgctgagtcctgggtgtcttccgggacgtcatgccttactcggtttaaagctcgtcctcgtctctttgccagccttggctgtggtggcttgatactactgccgttgtgagtggtgtggtgatgaggcaggaggcgccagcccagagactcagggtcttattactccttggtgagaaacaaaacttctcctggggagtcgcttagaagggttgccggggctctggacatccttgtctatactctgtggtactgggtacgcaatgtattggtgttgatggagtacactttatggcaggaggagaacaggattgaagagcatacctaaaactcaatttctacttcattcattacaggattgaagtaatttatttttggtagttaatagtataattactaactgataaagttt

SEQ ID NO: 392810 - DNA, 170 bp, Homo sapiens
ggcattgtggcacatgtctgctggttcagcttctgtggagtctgcagtgggaggatggcttgagcctaggagttcgaggctgcagggagccatgatcatgccattgtactccagcatgggtgacagagacagatagtgtatcgaaaaatgaatctggtaaagtttgggta

SEQ ID NO: 392811 - DNA, 563 bp, Homo sapiens
accctgctactattagcttaagcctatcaaattctgagtgcttattggctgataggatagtcacatcatggagtgcctaaattaacactacatgtgaatttaccgtgtcgactatagcttgaaatggcgcccactgcctgatgcctaccagtctttctattatacatgcttcattaagccctaccttttctccacatttcccaagaagtgattttctttggttcttgaagtacttttgtacagatcattggagcttaacttcgttcctttatcaggaagtgttttatctcacctgcaagttcagtaaacacaattagcaagtgaggtggctttggaaaggaatagtacaccctgaaagaaacatagtgcccagaaactagatattggatattgcaaatttttcttttagagttactagagccaccttcctgaagcccactggagaaagtcactcaaaatagttctgtgaccaccatttagccccagttctcatatggtatacttgagactctggacagtaagacgaggcagggttgtaagtttgcacccaataccaggttaca

SEQ ID NO: 392812 - DNA, 355 bp, Homo sapiens
atattggaacctgcaagtgtgcagttcttcctgcagcttcaggcatgtatggaagtaaccaaggatgactccgacacagagactgcaaagaaccagctaatgagggggctggccactatgctgtaattgaaggtggtaagagccctttacaggaggaaagtgggtgcagatatggtcagatttgcaaattatgttgcatccaatgttgagaggaattagaggttgtactctggggaggaagacagcctagaaattactgaggcctgaacagggaaaagcaccttatgagagatctttcaggatgagacaaaatccagttaattttttttttaaataaaaatatggaacgcttcat

SEQ ID NO: 392813 - DNA, 118 bp, Homo sapiens
ccagcatgctggagcgtggtgggaaggagagaagcacacagtgaggttggcgatgagacagggtgagatcacgagcagcagtgaggactctggactttgtcctgaaggtcatgggtag

SEQ ID NO: 392814 - DNA, 350 bp, Homo sapiens
tacaggtgtgaaccaccgcacccggccaggttgctaagtcttcatctctgctctgacaagaaaaagccacaggatgcgtattccctcagcttctcttctactcatggtctccaggattttactgttcctttctctttcctgcacttgaagaggccctgttgctattctgggcccccatagtacccatctcttttctctgttcctgtaatagtccattgctataaaggaatacatgagactgggtaatgtattaaaaaaaaaaaaaagaggtttatttgtctcacagttctgcaaactgtacaagaagcctggtgccagcatctgcttgacttctggtgaggcctcaggaa

SEQ ID NO: 392815 - DNA, 277 bp, Homo sapiens
cttaatcagcaaaccacctccctctaccctattatttcacagaaccattactctttcatacttgtcagctctgcccttacaagctgacatttcattaagagacgtaattgaaaatctagctttcaggtaagtctgagggtcttccttcccccacgatttctctatttccgcccctgcctcagagcagctataaaccattttctgtccctgttagttaccatctgcttccccttcgtagttgatctcctcctcccttaacccacagctccgtgacaag

SEQ ID NO: 392816 - DNA, 187 bp, Homo sapiens
cggggggatatgaatatcatttcctattattttctgtctctagctatcggcccagtaactagcacgtaataaaacatggataaatgtttactaatgttactgaaacggacttttgtttggattaagaaccctacaagaaagacagaaaatgtcgccgggcgcagtggctcacgcctgtaatcccagc

SEQ ID NO: 392817 - DNA, 371 bp, Homo sapiens
ctgggcggggagaggtgtattccaagcagtcgtacggcatcatagcagatcatgcgttcctgaagtttcggttctcgtggcttcatggatggagagctgaggctcctgatgggattgaccccgtctgaatcagagagctgtaatggaatagggcaaaaggagacattccattacaaagtcaaaccatggtaaacaaccacagccaaaggaaatagaagaaagaaagaaaggaaagaaaatacaaaaaacaattatatacagaagaaggatggcaagttgctggaagacaaacagtttgcctacatcttagaattctggaacaaagatgtggccacgtttcttgagtcttttataggaactttagactagta

SEQ ID NO: 392818 - DNA, 488 bp, Homo sapiens
tcagctcaagaacagccttctccagaagtctcccctgagaactgcaggctggattccctggatgagcagtgtaggaagagcttatctgtcattacttcccagtgtctgtttatcagcttattcaatgcacccagaagcaagcagttccatggggattaattatttaggctatctaagctcaaagaaaactgatgtatgaaccagaggccagttactactttatgaataccaacgagagctaatactgtcattgaatacttatcacaggtgccgggtagcacgctcagagccctcactgcaacactaagagaaaggtgctactattatccccattctacaaatcagaaaactgaaagattagccagcatcccaagaccaggatctgatccaagcagcttagatgcagagccctcaaccactcacattctctccttaccaagaaatctccacgtgcagctatcttctactcagatggtactgggaggaca

SEQ ID NO: 392819 - DNA, 318 bp, Homo sapiens
ctcctgcaggcctagccctgtcttggcagctgcttcttggaggaaccaaacgaatccaccacaacactccaagggctgtgccctggagtcagcctgagaggggaaatggtgggaacttgctgttcattctcttgatctcagcacctgtgtgcctcttgcgtgcaagcatgtcacgaccctgggtacagagtttaaagggcaattctgactagatgcaacttctgtctcacactctgattttagtcctcaactctgccattacttacatgatatgccacgctccactgtacacagggaatttgcaaaagaccctagggc

SEQ ID NO: 392820 - DNA, 634 bp, Homo sapiens
ccattagatggccatgggggcgagttccgggagctggccaggggactccctcgaaacggactttgcaggattcttgctaaaactggacacggaagcctgaggctgaggcctcatggagaagaggagcctggctgaagttcaggcctggtgagaggctttgttacactcaactctgtcttcacagagcagaagcatccgtagacgatgtgaaatgaatggatgtggctgtgttccaatacagctttatttatgggcacagagatttggcttttatatagttttcacatatcacgaaatgtgattcttttgattttttttttaaccactgaaaaatgtaaaagccaatctctgcttcggacctgtgccagaacagggagtagcctggccgtatttggcccatgtgccgtagtttgccaatctctgtggtaggtattctataacccaaattttacagtgagcaaatccagagaagtaacgtgcccagtccttaacaatgaaatgtgtaaccaggatccacacagagcctctcttagctaaagctcatgttctgtatgtcgcatgtggctgcctgtccttggatctcccgtcggaaagagctgcacaaaccgtaacagcagagatagttgtatacgga

SEQ ID NO: 392821 - DNA, 369 bp, Homo sapiens
aatgcaagagtttagaattttaaaggtggaatagttctacagagtggtcctgggagggaggaaggtaacaggagctaaggaggtcaagaatctgtgaagctgtggggtcgaaggacactgagaaaccatggcaggatacactatccagatctcgaagttttcagggaacaagagggtatacctgggagatctacgtatgagaaggggtgaaggtgtgagcttgataagttaagcagagtttattcagaagttgggacaggtcttcctgtggtgtgcatgccatccatgactgtctcctgggggttgtacaagtggctgtgtggtaagggcaactgtggcacagcctcctgttagtgacaggcttctagg

SEQ ID NO: 392822 - DNA, 566 bp, Homo sapiens
ggaaagtttattctttctttcacatcatggctttttgcattgagtcatgacttccctaaatattctttcccccctgctaaccaaacaccttcagttcctgcgctcttccatttagaagccactctctgggcacattcaccttggtgctcactagttttactgtgtccctcttaaagtcactgcagaaagtgtctaaaactggccaggtgtggtggctcacacctgtaatcccagcactttggagggccaggcagattacctgaggtagggagtttgagatcagcctgaccaacatggtgaaaccctgtctaaaaatacaaaaactagctgggtgtggtagcgggtgcctgtaatcctagctacttgggaggctgaggcaggagaattacttgaaactgggaggcagaggttgcagcgagctgagatcttgccactgcactccagcctgggtaacagagtgagactccatctcaaaaaaaaaaactctaaaacttatttttcctcagaaagtaaaattaagcgcatacaaactgaatgatgatacccaaattgcaactgattctcct

SEQ ID NO: 392823 - DNA, 369 bp, Homo sapiens
agggaatttctgctcgttcttcagggcctacctcaaaggttgcttccatttctctcactcctcctagtcctgacttaaccatttcttctatactcccttaaatcaagaaacataacttatcaaatacttatcatggtgtccccacccactagcacagcacttggcacaaacatgtaaatgagattttttttttttcctcactgaaattatcaaggtctgagctcacacctgtaatcccagcactctgggaggccgaggtgggcagattacctgaggttgggagtttgagaccaacctggccaacatggtgaaaccccacctctactaaaaatacaaaaattagccaggcatggtggtgggcatctgtaa

SEQ ID NO: 392824 - DNA, 488 bp, Homo sapiens
aatctcatctttctgttctaattatttccaagagtttcaatcagcatttcctaagttgtgttctacaagtgttaaaaagggttgtatttaaaaaaaaaaaaatcagtactagaaatacttttttcctaaaacgtattacatttatgtaagaaaaacagttttaaagctttaattgttgcagaatagccagaagctaagaaatgctgggccggcgtcaggagaaggtgtgcccagcggcctcgtgcgggtttacgctctggccacaagcagccagccctacgctctcactcaaccgtgcaattctttctgtcctacgtgaccctagtttcctaaatgacctattctgcatcctgcacattttaagaatgtgttttatttctccttcattatttgattgatttttttctactactaaaacaagcatatatttacaaagtatatgaagcaacacgtatacggtgaaagtcaatctttttcaccagtcttct

SEQ ID NO: 392825 - DNA, 228 bp, Homo sapiens
agtgactactgtattaaacagtgcaagtttaagaagattcttctagaaggcaaagagtacagtattcccttgattcttctatctttaacaggattcttctacagctttgatttttactgggcagcttggttcaatataaaattcttattccttcagttacctgaaaatactgcaccactattgaattctgtattgctatgtggacgtctgatgctaatctgactttct

SEQ ID NO: 392826 - DNA, 256 bp, Homo sapiens
agaaaatgaaatatgcctgtcccagctacccccattttcctgcccaggctgcctactggtgcctcatatttaacactgctcagtcactcattgattctcttcattctggaatgagtctttacgctctgagatttgtcatgcctatagataacttttcctaacttggacattgttttttgagacagggtgtcacctctgtcatccagactggagtgcagtggcatgatcacagctcactgcaaccttaaaactccca

SEQ ID NO: 392827 - DNA, 486 bp, Homo sapiens
ttagttctgtcgctctaagagaaccctaatacagtctgcttcccctcatattcatcaaatttctgtctcaataagtcaaagaaggaggcagagtttgtattttatttctaggcatcaggaaacacattgtttccctagtctagtgtctagttagaaaaaactaggaagaatgatatataggagatgtgctgataagtgtttaatgctctgatatatatatttataaaaaagctaatttttagtggttgcccatttccattgtgtaagtactcccaccatggccaatctcaagctactaacaggatgttactagactcagagttggcaagagatgcatgcatatgatcagctcttatgagctggtatgaacagctttaaacacacccaggaccaatattgcatctttaatccaatcaagttgactcccagtattaaccatcacaatcaccaccatcatactctttcacccagaacaccgtcgaaggg

SEQ ID NO: 392828 - DNA, 232 bp, Homo sapiens
aagaataaccagagtagaagaaaagcatactacaaatgttaaccatccattccatctccatggtcaccttagaatgtcatgtgtcaatgaaagttgaaaggttttagaagcatggtataactgataatacgttttagctttatcatttagcaactgggtggccttggacaagcacagtctcttcagcctcagtgttttccatctgaaaaatgggtgcaatacctactcttaa

SEQ ID NO: 392829 - DNA, 297 bp, Homo sapiens
cccgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcgcgggccgctcgccccgccaggctggagcggctcctggctccaaggttgggagccgggccggcagactgggggaccgggagagcaaag

SEQ ID NO: 392830 - DNA, 244 bp, Homo sapiens
ggctttgtataggaggtggcacgtaccaagagtggtacaaaggaggtagtatttctgaaactgcgagaagaatcaagtgtaggatcactaaactttcaatgtgtccacgggtgccatcttgcatttgtacctctgccctctccttggacattctaagagtctcagcctctctcctttggaccagggcaggagcctcctcactggcctgccacccattctccaccctgtggttgggaagaagtct

SEQ ID NO: 392831 - DNA, 249 bp, Homo sapiens
cttagcttcgtccttttgatacgcctgccaggacacaccccagctctgcctgtatccagccatctgccagccacccactgcacccaagttgctaaggctgagtgacaaggttacatcatggtggcctgatgccaccgtgggtggatcatgctttcacccttggcagggcctgcatgctgctcagcatgtcacccaggccaggtcttgctcctgttctacacaacaaatgaggtacaggactccaaatcc

SEQ ID NO: 392832 - DNA, 411 bp, Homo sapiens
cacatggcaagtaagtggccgccactgtcctccctggtccagtaacccccaactggccctcttagtctggaagatgtcctgtagtggccacgcccagtcccagtaagaagtcctcactggtcaatacccaattctctgtccgtaggaacagaagagagatttctgcaagatagggtttctggaagagcccagccccctctttcctatggcacaatctgggtatcactggcatcagaacttatcagcagaaagaaataaaggcaatggaggccaggtgcggtggctcatgtctgtaataccagcactttgggaggcccaggcaggtggatcacttgaggtcaggagttcgagaccggcctggccaacaagacgaaaccccgtctctactaaaaacacaaaaattagatgggc

SEQ ID NO: 392833 - DNA, 764 bp, Homo sapiens
tgtcaggctattagaccacatgcaaacagtggttggctctccaggaaggaaattagtgctgtcccatttttttctccatgaacagttaccaaactaggctacaaaaggatatataaaaaacatatataaataagaatataaagggagacctgaatcagcattagaggacctatggctttgggggtaccatgagctgagaactcaaatgtatcaaacacactaggcaaggaggaaaattactccagaaaaatgggtggtgtaagaatcagtactagattttggagaaaggctaactgccccatctgtgcagctaagagagatgagctaaatgtaccgccacaataactatgttgtagaagttgaggacaggggatggggataaagaacacagaactgttgatatgattctagctcattattttgaatttgggcaagaaagttatggatgaagattccatatgactaaaatctctaaaactccataatgaaggtagttttccttactgtacaattgttctttctgtctgggaataaagtttggacccatttctaaattaaaggccttacaattattatggagaacccacgaatatcagtacagcgctgcagggcaggaactatagtagtcacatagttcacagctttgccacgaacgtcagcttcccagaactgggacttgttagtgagttggtgccgttattatccaagcagttatgggacccagacctaatggccttaactgtctttcagtgatatgaattacc

SEQ ID NO: 392834 - DNA, 650 bp, Homo sapiens
ggttgtgtatttttttaaggacgaagggaaatagtttagttcggggtggaaattaccagtgatttccacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaaaaaaaaaaaagagaaaaaaaaggacaaaacaaaagaacacagaagaagaaaaaaaaaaaaagaacacacaccaccaacacaggccataacccaacaagccgccaacgggatacggaaaagaagaaacagagagaccagagacgagaagacaaaaccgaaccacgcaagcacaagccgaggaccgaacaatgacaagaaccacacgaaggcaagccaagcacaaaagagtaagaggcggaggataacgcacggagggagcgagggcgaggcaccagaggaagccgagaaccgcagaaaagaaggaagcaaagagaggagggaaaaggacgggagaaaagcaagacaaaaaacaaggaggagacaagaaaagaacgaaccacaccaacaaccagagaagaagcaggaaggcagaagagaaacgagaagacacggaaaag

SEQ ID NO: 392835 - DNA, 1185 bp, Homo sapiens
ggaaaaacagaaactcctaaaacgtacagagcaagaggcaaggacaagagcagcatatagaagcaatgataaataagcctgataaaaagattgttttcttaaaagatcattctctcaggatcctgatgacctaatgagataatcaatatgatggcaatttataagctcctatgagatttgttggagttcattgtaaattctggatattagccctttgtcaaatgaacattgatgcaaaaaacctcaataaaatactggcaaaacgaatccagcagcacatcaaaaacttatccaccaggatcaagtgggcttcatccctgggatgcaaggctggttcaatatacgcaaatcaataaatgtaatccagcatataaacaaaaaaaacaacaacaaaaaacacaaaaaaaaaaaaaaaaacaaaaaaagaaaaaaaaacaaaaacaaaaaaaaaaaaaaaaaaaaaaaaaacaacaaccaaacaaacaaacacaagaacaacgagacagggacgcagccaaccaacccccccggggcacaaaaaaacgagcacgcacccagaaagcacgacagagagccagacaaaaaagcggcacgcgcacgaaaacaacagcacaacagccgcactcactacacacagcggccagcaaaagaaacagcgcgcaagagagataccagaaagcaagcaccacaccggggacgccacacaaagaacccacagcaaacaccacacacagcatacccacagccccgcagcagaaacgatcaccgaccccaggacacacagcggcagccacaacaacgagcaacagcagcccgcacagcaccacgcccgccccgccagcgacccagcaacaaatcaacgcgtcgggcccgcacaccaccaccgcgccagcgcggggtggagagaagggggggggcggggagaggcgcatggctgccacgagagacggagcagggaggacgtggagacgcgggacggggaggaccacgagcgcgcgcccaggagccacgcaaaacaaacgccaggcaacacgacgggccacgccagcagcccacgagacccgcaaggacgacgccgcgcgaccacgcagcgcgacgagacgtacactaacagaacgcgaggcgagcgaggccaacaagtgcaactaagcagagcaggccagacaagacgagtgttaaagcaac

SEQ ID NO: 392836 - DNA, 457 bp, Homo sapiens
ctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcat

SEQ ID NO: 392837 - DNA, 234 bp, Homo sapiens
agggttttgtctgtctcattactgttgaatcctaagcacctggagtagtatctggtccatattaggtgctgaataaacatcagctgaatgaatgtatccctctagttagcagcttaaaactaaccagaagacattgtctaggtttcagcctaaagactatcttaaccccaaaggcttctctgaccctaactaaagtagatcccctctagttctccttcacagaccactgcataa

SEQ ID NO: 392838 - DNA, 505 bp, Homo sapiens
tggaaagtgggggtgcatggatggtgcccaccttgacacggggtgtgaagcttgaagccctctccttggcacggagaagtgctcttccaatagtggatgcagttactgaaccttaattacatcctcactttctgatacattgcttgttcttatgtcactaatacaaggtcattataataataatatagtcatatatcttatataaaacactaattgtatttacatatgaatgctaatgtaaaaacatatttgcaagattattttatgtaaaaataattatgaaaacttgaagcatacagaaaagtagagatactagaataatgagcccctaaacacttatcatgtaatagatatcctttcccttgctgaagtttttggaagtaaattatagacgtcatgatcatttgcccgtaaatgtttgaatttgtgaccctaaaacgtgaggattttttcttacatgagctaatgccattttcagttttaatagaataaaacatactttctt

SEQ ID NO: 392839 - DNA, 539 bp, Homo sapiens
tcctcctcctatgcttccaactcctcctccccgagtaggtctcctggcctaagcccctcatccccttcccctgagtttttgggcctgagatctatctccactcctagccctgaaagccttaggtatgctttgatgcctgagttttatgctctgagccctgtccctccagaagagcaggcagaaatagagagcacagctcaccccgcaacaccgcctgagccgtgaccctctataagcatcctctaagacccacagaaggaatcaacatttacccactttgtgaatgggctgcctgccctgtagttagctgcgaggtctcccaaagttccagccgttaaccaacatcctgagtagtttagaagcctctcctccccatgactccaccacctagcacttaacctgctgttggcctttgattctgggccaccttcttcctcaagagtttgcctttgcccttgagctgagatttctgttttccaagttgcttttctgttatgaaatgttttaattagtaaaataaattgttttgtttaaacaaa

SEQ ID NO: 392840 - DNA, 532 bp, Homo sapiens
ctgagatcgcaccactgcattccatcctgggcagcagagcaagactccgtctcaaaaacaaaacaaaacaaaaaaaactccagctttgtaaattcagtgatatattcctttttgagggatgcactttactgtattcatttcacatgtgaattttagaatcacaggaacagtctcaaattctggatatgccctttataatccccgtgatctaggacaacttgcttaacctatctttgccttagtttatcttctataaattagagtttctctaagtattacctagcatgatgcctttatttaaaaagtgcttgatccagtgccctacgcagcagaagggtaatttcacattgtagtcattattgttatgtgagtttcttctccagtagtctatatagtcacttgttgtactttaaaaaacttttaattgtatgtgaacctagttttgataatacagctatttcctatgtttttttaaagtctatcatagtctatcagattatctgttcacttgggaaaagacatctaaaaacag

SEQ ID NO: 392841 - DNA, 697 bp, Homo sapiens
cagcctcctccaggcctgtccactcagcagccagattcatctttcttttttcttttttttaagaaacaaggtctcactctgtcacccaggctggagtgcaatggcgcaatcacagctcactgcagcctcaacctccccgggctgaagccatcttcccacctcaacctcccgcgtagctgggactgcaggctcatgccaccacacctggctaacttcttatttttctagagacacggtttcacttatgttgcccaggttggactcaaactcctgggctcaaatgatccttccgcctcaacctcccaaagtactgggattacggatgtgagccactgcacccagcctcatctccttaaatccagtcacagtactttcccgctcaaaaccctagattcaatggctaccaattgctcttgggataaagtccactaccttcccacagcctgcagggccctgctgccctgccccctgccctctgcttgtttccccagcctctcccaagttccttctgtcttcacttgctgtgttccagccacactgaccatcacactccttcccctcctcagggcatttgaacatgtgactctctgtcccctcttctatgtctcctacttaaccctcaggtctctacctaaaaatcccttcctcaaagaaaccatccccgaccccacagactcctgttacactctctttatca

SEQ ID NO: 392842 - DNA, 267 bp, Homo sapiens
acatcaatacaataccgagcctttgaattcatgaatacagtagagctctacgtttattcttattatcttgtatgtccttcactcatgcactgttgttctccccataaagaacttgcccatttcctaatgggtttattcctatactttttattattgttgtgaattagttttctccagcccccttttttgttttgcttttgcttgctacatttctttttcatctgcttactaatcactctacttcattcacaggcacacacaaagtaa

SEQ ID NO: 392843 - DNA, 178 bp, Homo sapiens
ttaccagaatttggccacagatctgactttgagtttcctggtagtcaaagcaaagagagaaacaagaccaatctcttgattcttggtgtcctgaaaataccagcagatcagttcctcggaagaactcttcctgatagatacctgtggtgttcacaaggaagcccagcataatggatgg

SEQ ID NO: 392844 - DNA, 480 bp, Homo sapiens
agtagatgctgtggccattggtagaaggatgaagccaacctgtgacagctcagcacagagggcatggagggaatagatatcctgacttaacttattccaccctttgaactagaagccagaaggcaagggagctattggtggagttcataatgcctccagggacggagcattgagggggctgcatagagagtgaatcttgagcagtgagtggctctttcatattgctaaccattcctaggtgactgcggttatctgcatggttgaatctaggtcactactgtgtctgtgttctgtcaaagtggaagaagaaagactagagggaatgtaaagaagtacccaatgtcttaaggcccaggaccagcaatggtactcagcacttcaaattcccttctaatggtaaaatctagccacctggccatacccaactaattgcaaaaaagaaatgggtaatgtcaaatgactggagagacatgttcaagg

SEQ ID NO: 392845 - DNA, 168 bp, Homo sapiens
acattaaatacctcaggtcagcaacaaccttaaaatcaataggatacaaagaaaacatctatgtaggacaaatccactattttggaacatctctcgttgttttcttttccccatgtttggataataaacatggcagtgcctcaggcctctagcactgtcttctatagc

SEQ ID NO: 392846 - DNA, 339 bp, Homo sapiens
tgcctgtaatcccaacactttgggagtctgaagtgggaggatcacttatggccaggagttcaaggccagcttgggcaacatagcaaaaccctgtctttacaaacatttttttaaaaaaaattagccagacatggtgacacatccctatagtcctagctactggaaaggagaatcacttgagcccagaaatttgaggccagtgagctatgattatgccactgtagcttggggcaacagagtgagaccctgtctcttaacagaataaataaagaaaaaagaatttgtgggatactattgaagtagaactcagaaagaatttatagccctgaatgcctacat

SEQ ID NO: 392847 - DNA, 805 bp, Homo sapiens
cacggtggctcacacctgtaatcctagcactttgggaggctgaggcaggccgatcacctgaggtcaggagtttgagaccagcctggccaaacaatgacaatcttttagtagagacgatggtgaaaccccatctctactaaaaatacaaaaattagccaggcgtagtcacacatgcctgtaatctcagctacctgggaggttgaggcaagagaaccactggaacccggaaggcagaggctacagtgagccaagatcttaccactgcactccagcctgagtgacagagggagcctctgtctcaaaaacaaacaaaacaaaacaaaaaaactgagaaggctgaaaggctaagtacacagccaataaatggcagaacaggcattaaaacacatctttggatacctggatacctgtatccaaagatgtgttttaccaggatacagatcatatcatctatctgtatatgcacacaaacatacaatattttcactaaaaaatgggaacacactaaccacatagttttgtaaccagccctttttcacttagcatattgtaaacaacttttctgtcaacaaatacctatctacaacagcagttttaacagctgcatagtactccactgccagggtatgaaattgctttaaatagtatatttcagccaggcgcagcagctcatgcctgtaatcccaacactttgggaagctgaggcaggtgaaatcacctgaggtcaggagtttgagagcagcttggccaacatggtgaaaccccatgtctactaaaaatacaaaaattagctggacatggtggc

SEQ ID NO: 392848 - DNA, 205 bp, Homo sapiens
tagtttccattccagtgtataccgcaacacctgtaaaataaaacaaaattgtctcttaaaataatcctctagcatgtttcacaagaaataaatatatttaccagcatgaaagcttttagtgtactgggttttgtaccttttttgctcctatcccgccgtcaattttgccactactctgataatcattgaagggcagaaattcatg

SEQ ID NO: 392849 - DNA, 556 bp, Homo sapiens
tcgatctagaggatcccagacatgtcgggtgttttgtgtttctgtcttagaaaagaatgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctc

SEQ ID NO: 392850 - DNA, 198 bp, Homo sapiens
aattaatcgcatgaaaaatagtatatctttttcagtaactggggattttcataaaagccatcaaagatataatattagaagatctgctgttaagatagctgttgtcataaaaaactgttgatgaattttgaattttgactattaactgtccatgctaatcagatattcagagaacaataaacagcatttgctaaattc

SEQ ID NO: 392851 - DNA, 527 bp, Homo sapiens
gctgcatgtcactgcctcatgatctgcccgcctctgcctcctaaagtgctgggattacaggcgtgcaccaccacacccagctaatttttgtatttttagtagagatggggtttcactgtgttggtcacgctgacttcaaattcctgacatcaagtgatccgcctgcctcagcttcccaaagtgctaggattacaggtgtgagccaccacgcctgtcctggtagagcttttattatgtaaaaatctggtagggtggactctctggtcttctcgtcctccagatgtgcacatggcagtttatttttgagaagttgatatatttcaggcactctccccttacgaactccatcttaatctaaagagtttttgtcagatgaaggagggggaggcatatagagcaaggtaatgaaatgtgctcagcatcataaaaaggtagagcttggaccttgccaattacagagtttacccttcaaacaccatgcagtattttttcttggagaagtcttttcatttcactttcagttaata

SEQ ID NO: 392852 - DNA, 182 bp, Homo sapiens
caaccccacagcagagcatttgcagaataaatgcaggtaaagaatgagccagccacttctcctgccccaaatgtctccaccatcccggacacctctgccttgccctgattctgccatccatctcagaacagacccttttgcttacagaactgaatggaacagccttagtaattattttagcc

SEQ ID NO: 392853 - DNA, 188 bp, Homo sapiens
tcaagctcggcaccctccagattttaaaagcacaaacatccagctgttttgctgttggaaagttccacttacaaatcaattcaaggagaaagtacttcttagtctccatgttccctacatagaggaaaaaaaacattttgtctaccctcctatgttcagttactgaagcctgcaaattaaatggataa

SEQ ID NO: 392854 - DNA, 708 bp, Homo sapiens
atctatggtcacacctcaaggtactagagaaacaagaacaaaccaaaccaaacccaacagaatgaaggaaataaccaaggtcagagcagaactaaatgaaattgaaacaaaaagaaatgcaaaagataaatgaaacaaacagctggttctttgaaaagataaataaaattgatagaccattagcaagattaaccaagaaaagaagagggaagatccaaataagctcaattagaaatgaaatgggggatattacaactgacaccacagaaatacaaaagatcattcaaggctactatgaacacatttacgtgcataaactagaaaacatggaggatatggataaattcctggaaagagacaaccctcctagcttaaatcagaaagaattagaaaccctgaacagaccattaacaagcagtgagattgaaatggtaataaaaaaattaccagcaagaaaaagtccaggaccagatggattcaagttgaattctgccagacattcaaagaagaattaataccaatcatattgacattattcttcaagataaagaggaaatcctccctaaatcattctgtgaagtcagtataacaaagaaaactacagaccaatacccctgatgaacatagatgcaaaaatatttaacaaaatactcgctaaccaaatccaacagcatatacaaaagataatccgccataatcaagtgtgtt

SEQ ID NO: 392855 - DNA, 667 bp, Homo sapiens
gctcagataatataaatttttgccttactgtaattggattattttgattttttaaaaattatctttgagaactataggtctaccaatatcataaaaactagtcaataaatactttaaaaacaattcaacacacgtactgaaagttgctggtatacagtggtgagcaaataatagcagaccttcaggagcttatattccaaggacagggatggacattgataggagaatcacacaaacaaaatgcaaagtcacatcaggaagttctgggcagcaccttgcagaggtggtggttggatggaccatctgtagggagtgaagcaggagttacctgagtgattcggggaggaggggcccttcacatgtgcaaaggcccagcgcaggaagtgacgggagaggaaggccggggccaaactacctcaggccttttggtcaatactgaaggttttgatgttttctcctgggagtggcggaactccattgaaagactccaagggagtggcatgaccagaatgatctctgacggctcgctctgggtacagtgcaaaggacacggtgggaggaagccaggcaggccctcggctgtagtggtctagggtagagacaccggcaacttgggaactaaatgtgggcactaaagataaagagatgtgtgtggatccacgagagg

SEQ ID NO: 392856 - DNA, 278 bp, Homo sapiens
cttctgttctatccctcttcagctctcccagctggacctcagcttttccaatcccaaatcctcctctacttgttggatttttccttggagtctgtctctcctacccagagcatttccttctcagcctgctccctctcctcctaggctaggtcctctctccagttctcccgccttctctgccccccggtctaggtctctcccgctgactggttagcctgcatcaccactagctcccctcagtctcatctctctctcaggctctctactcctttcagcct

SEQ ID NO: 392857 - DNA, 881 bp, Homo sapiens
atgagacattatcgtgatgacaagaagattctgagcaatgtgggggagtgagaatattttcataatatctgccattagaatgacttagaaatggaagacccaggttcagaaattaggatcccatgcacactgtactcttgtgaggaggtgcagaagttatctcttcccttggtaatcctctttcttagaactcggatatttatcaaccacctaactggctgcttgaaggatggacacctttttttgttttgcaaagaaaggaagttgcaaaaggtcacaaagcaactccatatcctttggaaattttagagtgccaggcttcatgtagataaaccgaaaacaatttaagtcttttatgttgtactaagtcaagagttctttagcagtggaagaagatggggtcttacatgaatggaagggtctcggctatttgcattggtatcaagagaaggactagatgcttgctctaaaagaaaaagctgagggatggggacaggaagcggggagcaaatctgagactgaataaatgtaaataaaagagctaagattgttgagcaggtgctaggagctgggtcagattttattccccagaaatcttaattattctgcctcctcctagatagggaacgtgttgcttacctttgcatccacacctggctcgcaccaaccatgcaacccataattgttcatctgatgaaggttgtcaaaggcttggacaacccttcagtaactctttaagggaaaccacccacccatttcatcttatcggcttggctttcagtatttatcatgtcagtgactctttatcccagacccgaggttgattttggtcacctggcggggtcattagagccgtgatgtcatcacacacctggcccagc

SEQ ID NO: 392858 - DNA, 755 bp, Homo sapiens
caaaagggcaaatcaaggggttctggtccatcttgtgtcattcaaactgtagttttgaaaagttcaattagaatgttttgcccgtgataagaatcacaagagactcttcaagtgctttatcctgggagagttgagtggtgctgcccagcagcagcgagaatgcttctcacgttgctattcggtggcccctgctccgtggggtccggagcggttcaccgcctggcttttgactgtttataaatttggattacaaatgactgtgaaatggataacaatatgtgagtataggtttcatggatcgattcccggcctggagcagggaaaataccagaggagcctcagacatcttatggggccagaaaatgaagaggtgcttgaaaaagaaaggggtatgacaagaagccacatgactaacctgaaggagcttccagtggccaaaagtggagcaatttgagcaacaaaataaaaaatgagaataatggattctaatccatggaataaaaataaatatccctaagtccagattgatgtaaataaataattgaataaataataaacaacagagaagagacggttcttccttatagaagaacccaggttaatgattgtggaaggaatgagaaaaatacaaaatcatcactaggcaaactttacagcagcaactgctgtcagcaagagccatgggtggacactgcaaccactgggcaaggctttgaggagaagccggacattctcattgtcgcagctgatggaga

SEQ ID NO: 392859 - DNA, 697 bp, Homo sapiens
caggagaccagcaagctgcctgaccaacaagtccagttttccctttaaatgcagaccactgaacactgtgaagggtaggggtggctcctgttttctcagaagggcttcgggcagcccagccagccttttccaatggaaaagaggtctcagcgttctcaggaacagagaatctgcagatgcctcagccatgacgaatttctttgctgcttttattgccccctgcaagagtttctgtgatctttctctaccttttggcttcactctcttgacaggtcttggtgcctgtccacagaaggcatcatcttattgacataggatgtcctggcaactgcaaaagtgtgccacccatgggtgtcaaagtggctttcacccatgttaacgggagggcctagggagtgggaatatccactcttacccacgtacaccctatctcccctactgtcagtagccttcaaactccctagacctcatttacaccatggatacgagctgaactttgtccatgaaatggaaggtttggcttatttggcaggaattagtcatgttcacctgtgttgtgccttttaatttctattatcatctgcctctggatctctcagatccagttttctttcctagggctttgacccaaaaactggacttgaatgtgggacaaaaatgtgtctccaagtgaggagaggttcaatggactctttat

SEQ ID NO: 392860 - DNA, 560 bp, Homo sapiens
ggaccagtttgcccagccttgctctgctcccccaccaccagtaccagagcatgtggtccagagacctggggaccacccagcccagtccaccattgttggcacctgagcactcctcctggaagcttgagttcaagcccacccaacctgccattaccaccacagtgggcacacacctataggcctacggactggcccacccagcacatcacagccactgtcaacacaagtacagaccatgtaggacccagagattagtccatctactgctactacaatcatccatgccatgaccattgcccaggggcctgaaaacccacccacttgcctagcccaactctgctactaccagcacctgagaaagccacctggggatccaagaattggactgcctggaaccactgaaaccagtgccaatatatgccaccctggagcccaagggcaggcatgctcagcccactgctgccaccacagaggtctgaagataggaccacctggcattgctgtatccagcaaaactttgccacagtctccactccactaacaattgcaccctaagccac

SEQ ID NO: 392861 - DNA, 294 bp, Homo sapiens
ccacctcagcctcctgagtagctgggaccacacgtgtgcaccagcacacctggctaatttttgtatttttttgtagagatggaatctcactatgttgcccaggctccatttacttattaagtacttaatatgtgtcaattttagtgatttgtgtttttctagaaaataactttcatctaagtttatgaattttatgtagagaatttctgcaaaatatcttgactcttcattctttcttcatctatggtccttttctcttgtcatgtcttatttagtcagcccagaggttatcta

SEQ ID NO: 392862 - DNA, 499 bp, Homo sapiens
ctatatcctatgtaagtatcttagattgatcataactgtagagttagaaacactcgtaatatatttacttcaaaagtttaggaaaaatgcatatagcagtttgataataggacttttgaaatcaaaattatcttaatctcaaatccagtccaagatttacatactgaagcccagagaggtttagtgacttaatgtttgttacaagttagcattcggtagttatgttgagaaaagttcaacatttttcttattaaagaagacatacaatattttctttagtctaggagagaatagatagacagttgtttggtttctttatgatgatactagacaaagtttccagatttttttctcactttaatgtttcctctaacttcctagtttttaattagaaatcatatattgtatctttaggacagagatctaatccttttttatagttccatctttttctgttgagaactgtgtttttggaaacagaagtgtctgactaaagaac

SEQ ID NO: 392863 - DNA, 228 bp, Homo sapiens
gagtcacgctggtactcataccgctgcctagtaccatacgatgtgatcttgcctatttggccttgaaaagtgctgagagtacaggcatgagccaccgcacccagccaagcgcagggaatactctttaaataacacggggacagggggtccttggattccacacatggaagtctccatagcttctctgtgtcaggaattcttccaggccaggatcattccctgctattg

SEQ ID NO: 392864 - DNA, 232 bp, Homo sapiens
ttaatgaatatagttggcactttaatgggtggacaggtggatggatgcataggtcgatggaaggacagatggatggatgtgtaggtgaaagggtgtatgtatgtatgtgtgtatgtctggacggatggatggatgaatgatggatgtctgggtagacagaaggattgatggatgggtcaatggattgatgggtggctgaaaggaaggatagatggtggatggatggatgaat

SEQ ID NO: 392865 - DNA, 446 bp, Homo sapiens
gattataggagtgagccactgtgcctggcccagaattcttacaacaatgaaaagacaacccaattaacaaatggccaaaggacctgaatatatagtttcccacagaagatttgatttctgccatgaattcaaagatatacaaatggccgatagggatagattctcaacttcatcagtctcagggaaatgcaaatcaagaccactgtgacagaccacttcacacccactgggatggctatttaaaaagacagctaacaagtgttggtgacgacatggagaaactggaaccctcatactctcttggcgacgatgcaaaatggcccagccactttggaaaacactctgggagttcttaatgttcaacatagaggtaccctatgacccagcaattccactcctaggtatgtacccaggagaactgaaaacacatgtccacacagaagtat

SEQ ID NO: 392866 - DNA, 689 bp, Homo sapiens
attcaaagctataatggtgacatgaggactagaggtatttctctgagggcaagaagtatcacttgtgtctgtttgtctggccagttgagcacgatgattccagccacgagagaagagaacgctgggctgagaggttagctgttggaataaggtttggttaactttggaattatacaatcagcaaagggatgtcctcaccagtacttctaagagatcaaacaagaggcctccagctccctaaattctggttctactgtaccaactctgctttaatttgttttaggtaatgggattccaggtgctattacattaagaattctaatttaactcttaaaaagtgttttcttagataaagtaactgggactcagggagataaagtaacttagtgactcacctaagtttccccttgtctccaattccagggtgccacccaccgtattatgatgttgatttgtgaagagactctcaagtaggttcaatttcatagtcccagtttaagagagaggccaagtgaggatttggcataccacgtcggaaaggttgccaagtcctggatttcactgatgagacggttccattctcatctatgtggctggtcggctgccacctaaaccaaggagagctcccatttgctttgtgtgaactggctttgctgtagcagtgctaactagccatgaggtagatttct

SEQ ID NO: 392867 - DNA, 438 bp, Homo sapiens
tgggcgaactgaccaagacgaacacgacgggacacgacggccactgcctccccctggcccttcaagtcctgacactgcctccaaaacggccgacggctgcccatgtcccaagagtgaggaccctggtgttgtgtccagcctgcccaccccaacagcctgtgcttacagcgtggagacatgcggacaggccagaggactcccagggagggcatggctgaggtcagggaccagggagcctggacaaggccccgcctctgcctcaccagcccccaggtatccaggtaccctccgcacacaggctccaccctccccagagccttcccagagggaccggcccactcccaggaccccaagaggaacatgatggatgaagatggcatgtgatgtccaggcagggactgacgcaggagcagcccaccctgcctggcctccaccccg

SEQ ID NO: 392868 - DNA, 4535 bp, Homo sapiens
gaagttctagaaaatgttaattgggggagctgtggctggcagagaaggaaaaaggaagctgaagggcacttgggctcataatggtctctccaaccctgatcctgtcctttatggacatttggcagcgctgctgccttgaggtgccttgcaatgctttatctttttgttaaagccacctctgttgcttcagccagcttgagcggttttctgttacttgctagtggttgggaaggcttagccgacgaagggaaaatgagtcaggtcctgaaggatgagcaagttacgggagtgggccgcatggtgagggagtggacttcctgatggggttaagggcgcctgaacacctgggaggcaagttgaggccaagacctggggtgatggagaggcagggtaggctacccagtgagtaggaggccgaaggaaccacagcagggctccagatctcctggcccagaggggctggtacgggaagcccagaagacactcatccctaaggggagcctgagactgaggaactctcatgccctgcgtcgggctcgtgggcgaagggccttcccagggactgcaccatggcctgtccccagccttacccaggggcctccctctcaggttctgaaggacccaggggtcacagctgtgtggggtgctccactgaacacttccttcaaactccttcaggctggagtgcagtggcgcgatctcagctccatgggagagagtttgaaaggatgaagagtttacatcctctggaaagaagcaaatagaaggcattccaggcaaaaggaactgcatcgagtaaaagcatggaggcaagaaagggcttggtgtgtttgagaaacagtgagtagggcatggtggtggcagaagcttaaagtgtatggcccgtggacagtgacagccggacaagaagctgaagtgacagaacaagttgaaccaaaggaattccagacctgggaaagtggagaaagaattttggggtcagagccgtttaagactttgcctagggcctgggtcttctttctcctaaaggcctcaacccacagcacgccacacaaatatgtcacataacacacaaacaaacatcatatttcacagtccaggaaatgaaatgaagacaaaagcgccccctgtgggtgaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcctcccggtaggccagctgccgagctgggctatgttctggaacccagtgaatcttgggggccaggcactgtgctaggcaccagcaggggtaacacgaagaagacccggcccttagggcatcaggaagactagctcccctgccccggaggatctgctcagtgctgatggcagcccagctgtgtggactcagggggctctgagggctagggaaacaggaagggcctctttgacaaggtaggagctgtgcttggaggggcaggaaaagaactgagcatgtcgcaggcagcgggcccagcctgagcaatggcaggatgtgaacttccccatcgcaaatgcagttctcagcccactgcagtggatacaaggaagggcctttctcggggccggagaagagaccaagagaccaggcccgggcagcagcctaccggccacgtggaacactggctccggagttattctctgtcaaatctactccccggacctcaaccatggcaagaaccagaggtccaaagaggcccagacccaggtccttgtgctcagtcctgcgcaaaccaggcccagaccctgcaagcatttgttgatgcccttgcaggcccactgggagaaagatgcctcaggcaggtctcagcctgggggtggcaggggtggggcagagagaatactgacagcagaggtcttggtgggctgcacgtgcctgcgaagatgtggtggacaaggaggctctcgggctgggccttggaggggtggcagcggaaggacagcccaggtggctgaggcctgatgggaagccggggaaggccagggtggaagggcggcttgagggacgccaggagaagactgaatgccaggctaggaaggaggcggctctcgatcacggggtgggtgcccccgacaccgggtctcctagcttgagttccctagaagcgaaatctgagagggggattctggggcaagtagtttcttgcgggtgagtgttctcagagaaacttaccagatcaagaaagggagctcaggctggatggaggaagccacgcaagtgtggcttcaagatccatcgccttggcctgatcgctgtgggggcaggggcctggagtacgaggggcaccctgggggctcccacccagaagcagaggggctgggctgttgcacctctactggcatcagtctttggttaccccccagccccagtaggaggagagcaggcagagcttgtcatccccagcctggtgtcccgcagtcccaggaagccgcttcttgccttcatggctgagtgctgggaagggctgagctcacccaggccagcaggtggggtatcatctgctcggtggggccacccacaggtgacagcatggaccctcaggctggctgcccctgttccttggtccataactggtgagctatggagacccaggccaacaaattatccccagtgatatggggggaggaggggctagaacaagggcccaggggactggaggcaggatggtggctttccctacctgacacagccatggcccagccccaaggccaggctgtctaccctatggccacagcaggaggtcagcccagggccaggagacacatggctggacaaggctttgcagcctgggagaccccgactttctctaacccagtggctgtgcggtgcaggccactgactccccccctgccctctcccctctctccctccccctaactgcatgacatgttaactgtgtgcccaggacagccgtggtggggaccgggtatgccaactggaatgattctagaaccaaaataaagttggggcaggaagagggggcttccagggagccctgctcggccctgaatcaccttcgtctcttctctaggaat

SEQ ID NO: 392869 - DNA, 4366 bp, Homo sapiens
gaagttctagaaaatgttaattgggggagctgtggctggcagagaaggaaaaaggaagctgaagggcacttgggctcataatggtctctccaaccctgatcctgtcctttatggacatttggcagcgctgctgccttgaggtgccttgcaatgctttatctttttgttaaagccacctctgttgcttcagccagcttgagcggttttctgttacttgctagtggttgggaaggcttagccgacgaagggaaaatgagtcaggtcctgaaggatgagcaagttacgggagtgggccgcatggtgagggagtggacttcctgatggggttaagggcgcctgaacacctgggaggcaagttgaggccaagacctggggtgatggagaggcagggtaggctacccagtgagtaggaggccgaaggaaccacagcagggctccagatctcctggcccagaggggctggtacgggaagcccagaagacactcatccctaaggggagcctgagactgaggaactctcatgccctgcgtcgggctcgtgggcgaagggccttcccagggactgcaccatggcctgtccccagccttacccaggggcctccctctcaggttctgaaggacccaggggtcacagctgtgtggggtgctccactgaacacttccttcaaactccttcaggctggagtgcagtggcgcgatctcagctccatgggagagagtttgaaaggatgaagagtttacatcctctggaaagaagcaaatagaaggcattccaggcaaaaggaactgcatcgagtaaaagcatggaggcaagaaagggcttggtgtgtttgagaaacagtgagtagggcatggtggtggcagaagcttaaagtgtatggcccgtggacagtgacagccggacaagaagctgaagtgacagaacaagttgaaccaaaggaattccagacctgggaaagtggagaaagaattttggggtcagagccgtttaagactttgcctagggcctgggtcttctttctcctaaaggcctcaacccacagcacgccacacaaatatgtcacataacacacaaacaaacatcatatttcacagtccaggaaatgaaatgaagacaaaagcgccccctgtgggtgaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcctcccggtaggccagctgccgagctgggctatgttctggaacccagtgaatcttgggggccaggcactgtgctaggcaccagcaggggtaacacgaagaagacccggcccttagggcatcaggaagactagctcccctgccccggaggatctgctcagtgctgatggcagcccagctgtgtggactcagggggctctgagggctagggaaacaggaagggcctctttgacaaggtaggagctgtgcttggaggggcaggaaaagaactgagcatgtcgcaggcagcgggcccagcctgagcaatggcaggatgtgaacttccccatcgcaaatgcagttctcagcccactgcagtggatacaaggaagggcctttctcggggccggagaagagaccaagagaccaggcccgggcagcagcctaccggccacgtggaacactggctccggagttattctctgtcaaatctactccccggacctcaaccatggcaagaaccagaggtccaaagaggcccagacccaggtccttgtgctcagtcctgcgcaaaccaggcccagaccctgcaagcatttgttgatgcccttgcaggcccactgggagaaagatgcctcaggcaggtctcagcctgggggtggcaggggtggggcagagagaatactgacagcagaggtcttggtgggctgcacgtgcctgcgaagatgtggtggacaaggaggctctcgggctgggccttggaggggtggcagcggaaggacagcccaggtggctgaggcctgatgggaagccggggaaggccagggtggaagggcggcttgagggacgccaggagaagactgaatgccaggctaggaaggaggcggctctcgatcacggggtgggtgcccccgacaccgggtctcctagcttgagttccctagaagcgaaatctgagagggggattctggggcaagtagtttcttgcgggtgagtgttctcagagaaacttaccagatcaagaaagggagctcaggctggatggaggaagccacgcaagtgtggcttcaagatccatcgccttggcctgatcgctgtgggggcaggggcctggagtacgaggggcaccctgggggctcccacccagaagcagaggggctgggctgttgcacctctactggcatcagtctttggttaccccccagccccagtaggaggagagcaggcagagcttgtcatccccagcctggtgtcccgcagtcccaggaagccgcttcttgccttcatggctgagtgctgggaagggctgagctcacccaggccagcaggtggggtatcatctgctcggtggggccacccacaggtgacagcatggaccctcaggctggctgcccctgttccttggtccataactggtgagctatggagacccaggccaacaaattatccccagtgatatggggggaggaggggctagaacaagggcccaggggactggaggcaggccactgactccccccctgccctctcccctctctccctccccctaactgcatgacatgttaactgtgtgcccaggacagccgtggtggggaccgggtatgccaactggaatgattctagaaccaaaataaagttggggcaggaagagggggcttccagggagccctgctcggccctgaatcaccttcgtctcttctctaggaat

SEQ ID NO: 392870 - DNA, 910 bp, Homo sapiens
caaggtggggcaggaccatacttcctcaaacctttagggaacatctttctttgcctcttcagcagtgtggcagccccaggtgttgggcttgcggcagcataactccattctctgtctcctcttcacatggtgctctccctgtgcgtctctgtgtcttctcttctcataaggataccggtcatattggattaaggtcctatcatgtccagtatgacctcatcttcactagtaatatctttattcaccctatttccaaataaggtcatatcctgaggtactaacgactttaacacatcttttgggggacacaacccataatggtgcagaagattgattgtcttgtttctcttttgcaggcagtggcttggtaaatagagttatttagatttgaatgagatggatttattgggtcctcaatacttctgtaaaatatagaagaaatagcctcttgctatgggtgatgaagggcgagcgctctctaaaattgatgctatacaagaaatatttaaggatcaactctgtgaaaggcactgttaatgcatgctgggggatatacggattgctaagacacgattcctgttctgtgagaagttacagtttgacataatccagcctttgtactcccaaaataaatctaaatgaagtaccactgatagactctctttattcttttcttcttcaatagctaaacagtttcaggaacatcaagaattgatatgggaatccttaaaatacgtaacattgatctttggtgcatcagctttcatgttcaaactttcgttctcagaatgtgcagtttaggatttccctaaaggtgttttggaatctgtgtcccttgtgttatggtttatatatattatggctgtggggagcatttcttggtgaatctgaagagattaaacatatgaat

SEQ ID NO: 392871 - DNA, 212 bp, Homo sapiens
ggtcatcgagcttcagaattccctgtagttttcactgaggcttccatttagactccattagaattcagtttctcccactgatcaattctacttgcttccattgccttctgcagtgtggttaccaagagtactcctaatgaaccttttgtgcactaatctccatctctttcttttttctttttcttttcttttttttttttttttttttgaga

SEQ ID NO: 392872 - DNA, 439 bp, Homo sapiens
gtcgagtggtgtgtttgtctcacttgcttccctatgggcttcgtaaaggcagggactgggtccccagcaacgctggacggtccctgggttaattaaattgttcccttttggaacgatatccattgaagtgccccctaaccatagtcataactaaaatttggacacttcctatatcccagcactgtactaagcaccttttgtgtattgtattctttaattatctttgcaacagccctaagaggcagatggatgtgacatgtacctcttacacattgggaaactgaagcttagtgattaattgatttgcccaaggttatctgtaatgggtgaaactgggattctaactcagtgagctggacttgagtctgagctttttacaccattaacacaagtgaggaagctccttagtggggaatgcagctctggctctgttccttgg

SEQ ID NO: 392873 - DNA, 397 bp, Homo sapiens
gtctgagttcaagccccgtttccataataccacgtatgagctagcgcattgagcaagttctcaggctttccaaaactcagtttccttgtgtgtaaatgggcagaactgtagacttaccacatggggttgctctaagaatggagacaaaacatggaaagctcttggcacagggcctggccctccacaaatggcttaaaaaacaaaagaacaatgacaacaaaaacaaccataaccacaaccaccaacaaacagaacgggagccggagtccaggactggcgggggcacgggttctgggcttgagaacatcagatagaggcgatgatttcccatttcatggaggcacagcaagtgctctgcaaaatgcctgactttgggattcctttaattagcgaggtg

SEQ ID NO: 392874 - DNA, 653 bp, Homo sapiens
ctctgtgggcggtttgagaccagcctgggcaatatagcaaccgtcctgctggcacacaaaccctcctgcctctaaacagaatttgatgggccccttggcaaaggcaggttttagaaactcctcgggggctggagcgcaaggagagtctgagccaggccaagcctccctgggggaacatggctgaaggaagacctacagacatctcccctgggtgggagcctgtgttcagaagcagcagatccaagtctctgtgtggctgaggagaggacatcctgctggcaacacggagaatgccatataacagctaagacagagatcagagccatgcagctgcaagccgaagcaggccaaggattgccagcaaaccaagagaggctggaagaagagagaaggatctttccctgctgatttcacagggagcatggcccttgatctcaggaccttgaccccagaactttctggctgccaataccaagttcctcctctccatctcacattcaaagagcacacagagaggctctaattgggtctttctacatcctgtgtccgtacagagctctcgcgtttgggtggggactttgcaccgtgaccagtctaagatcagcaccagcccctggtccaatcagctgtggccaagacccttgaagacacag

SEQ ID NO: 392875 - DNA, 144 bp, Homo sapiens
attaaaacacacacacacacacacacacacacacacacacacacagaaaagcctgtttccaaatctttaaaccttgggctgagatgtacaaatctgaagatatgctccaaagaaataacctggctgggtgtggtggctcacgcc

SEQ ID NO: 392876 - DNA, 184 bp, Homo sapiens
gcgagctgtagccaggccgagcgtacaaataaaaaaaattctataattgatttaaaagcagtgatttggatcaaacaattaggtctaattattgcatttattttattaaattgtaaacttactaaaataacattggcgtattctctgtcatagatttgtggcagctgtttccacacttgttact

SEQ ID NO: 392877 - DNA, 405 bp, Homo sapiens
ggattgtttgtctattttcttttcaaaagtgtgtcagatttccctcatgctctgtggtttgtttcctgcttaaattcctgacaatctgctttaaacaacattgctatatttgtgtccagaggatacaaaaaagttttaaaaatagaacaacatacattccactgtaagctttgaaaaaacttcctgaattatggctttgagtttcaaccaagacatggaggccatatttatggctgtgtgcatgtttgtgcatctttttgtgagtggaaattcattactgtacaggacatgagctctttccctaacactcgtgttaaatggttaatatgagatgacttggtggcactctgaagtacgaagtgacagacagagttaaagttcttgatgtatgctaggtcagtgaag

SEQ ID NO: 392878 - DNA, 332 bp, Homo sapiens
taataacaatgtgtgtagtgcacattcccttcctgtattttgcatgcagagcgtgttttaaagttgcaatcagtgttcataaagttcttggcacttccttttttgtacacaagtacattgtaatcattcacctcacggctacacaaccagcattcatcatcgtttcaatggttatttgatgcgttgcggtgaaagcactataacaaaattaatcatcttctacgggtcatttgtgttcctgacacatctgctgtcatgaataaccccatcgtgagttcttccatgctataactttttcctgctttaataattttcttaggacagatgcccag

SEQ ID NO: 392879 - DNA, 173 bp, Homo sapiens
gcctctccctcgcccttgccacacagagcctgacatgtattgggcaaaggaaagaaagatcacgtttgccgggctaacattgctgatgatgactgctagctagcaggacaatgattacacaccaaacacactgccacaactaattttcaagcagatcaaaataaatcagaaaa

SEQ ID NO: 392880 - DNA, 251 bp, Homo sapiens
cagaacagtaccttcctttaatgctgcgacagtcttctaaaaactcttgcagtactcctgtagaaatgaccttcttcagaatgattttgtctggtgttctcttcgttcagattctctttatactattaaaatgcattatcagtatcttttcctgataaatgacctgacaaaattgatattagtggatcgaagtaatatctttaaagttgatgtacagagaagaacagaacacaatccaggtttcagaaaat

SEQ ID NO: 392881 - DNA, 126 bp, Homo sapiens
cgtgacacttcagaccaaaccatttaattgctgttgtgactcgccctaactggagatcaagaaggccatctgtgccagatgtagcagctgtgagatcacagactctataagtccgggtccctcagg

SEQ ID NO: 392882 - DNA, 663 bp, Homo sapiens
gccttacaaactctggtgattgcctgtttgccctcatttatgataaagttccaaagtgattgtttgtacctcccatatttaattataagacacatcataagacacataattataagacacctatttaattataaaacacataaatcattgcaagcagtaagaaagatagctcgtctgagagagaaacacacacatatacaaacccaaaaagcatcttcaagggtcatttaatgtgagggcagattgattgccctgtctgcctcagtacattttaaaagatatcagtgtaggaatttaatgaactagttgacaagaggaacatttttttaaacatacttttttatgaaagactgggaaatatttaatatttatgtagggaagattttcatccaaaattaataaattaaaaatagttttgacatttaaagttatataatgatcatgtagtaggaaaatctctgagaaataaaatcttgactaataataaatggttaatatagatttactttatttatttcactatctcttggtactattttaaatctctaggactcctgtcatttttagttataaattcatgttttttgaaaattgagaaatcctaaagatggcatatttttgaaataatttatggattattcaatacaactggttggtgtatac

SEQ ID NO: 392883 - DNA, 318 bp, Homo sapiens
tgtatagacgtatgtgtaggtagagggtgcgtgttgtatagatgcatgtgggtatacagggtgtgtattgtatagacgtatgtgggggtagagtgtacatgttgtatacacatatgttttgggggtagagggcacatgttgtatagacatatgtgggtgtagagggtgtgtgttgtatagacgtatgtgggtgtacagggtgcattttgcatagacgtatgtgggggtagagggtgcgtgttgtatagacgtatgtggtggtagaggttgtgtgttgtatagatgtatgtgggggtagagcgtgcatgttgtgtagac

SEQ ID NO: 392884 - DNA, 265 bp, Homo sapiens
acagtgctggctgctccaggccacaggagaagctttcctgacagatgtgtcggattgaccaaaagaccaaaaggggctttgcggagattatgctgtctgctcgatacttggcccctaagcctcaagaaatggaagctcagagggcatccttggtggcttctagaaagggtcagagctttaagcaggggcccagcaatggtcagcttccctggccagccccaggctgcctccaaaaggcctggcggaaggcatttgccaaggtgtc

SEQ ID NO: 392885 - DNA, 644 bp, Homo sapiens
actctcccagaacaaaagaagaaaagctctaatgaagaaatactgttgaattcttaatgccatatttacactttaaacttgatgtcactatgcctgagtctaggcctaaagttcttgtgtgtgtttttcagtgctgatctgattgttttaatttagcattgcatggaaacagtgaaatgttaagagacaaaacatacataatgggtggaggcatatgggattttttttgaagcatattgtagtggccttttaaaaaaacaatttaaactagaagaaattttctgtaaaattaattttgctatttctttgcattttgtcttaatcatttatattttactttgtaccacaatggacttgagccacctaataaaaatacagtgcaaacatatgcaacttatagttgatagcgtggaatcaagatgaagaaaaaaataaggaaaatcttactttgtaagtaaaatgtgcaaagtgatttataagttaagatggaattttagagtttccttttatttgatgtatttcttgatttctagtattggtaagattatctttaagtcatgatttttatatatatggaactcaaaattgatagttgacaaactagcttttacaatttagtttatgtctgtcatttcaaaaaaaaa

SEQ ID NO: 392886 - DNA, 167 bp, Homo sapiens
gggaaatttgtgcttcttgtcctgcagtgttgggtcctagcattctagaggttctgcttcccagaggggaatacatcaggattctcagaatcctactaaaccgaaaactctaccttgtcattttatgcctctcatgacatgagatcatcaggctaagaaaggagtta

SEQ ID NO: 392887 - DNA, 205 bp, Homo sapiens
cagaagtgagacatcagcgaagaaacatcacgatcaccaaattacgatgaacaccatggaggaaacaaaggacactgtgacaccaaggaaggaagggaggttacttttcatagtggctgtaaatagaactgaaggctgaaaaacagctgttaaaatggcttgtttgtttgaagatgaatgagagtacacaataaaaggtaattct

SEQ ID NO: 392888 - DNA, 240 bp, Homo sapiens
tatttttatatatgtttattacttttgaaataatttgtttctcttgcctacttttctgtaagtctttattatgaatatgtgtaaaatgtcatcaaatgcttttctacttttaataaaataatcctataaaaatttaatatccttgatgaacattgatgcaaaaatcctcaataaaatactggcaaaccgaatccagcagcacatcaaaaagcttatccaccatgatcaagtgggcttcat

SEQ ID NO: 392889 - DNA, 274 bp, Homo sapiens
taacacctattttgtgcatggtcttggtctatgtgcttttgcagaacaaaaggtataatctttgtgcctagggatttgattatccaaatatactctctaaggatgcaggcatggcaagctaagaatacacccagttaaaatacttgcctttacgcatgtgctgtacacatttcagaacagataaagtacatggcaattttcctctaactattcaagtattactttaaaaaaattcacatcctgtggggtcataatcttcacctagggtaaatag

SEQ ID NO: 392890 - DNA, 443 bp, Homo sapiens
tgatatgtctttggttttgatatcaagtgacaccaccttcatagaaatgagtttgcaagtattcctccctcttttatttttcaaaatagtttgagtaggattggtattagttattctgaaaatgcttggtaaaattcatctgtgaagccatcaggtctgcgttttttgtttgtgtgtggtttggtatttatttatttatttatttatttattttggatgctttttataatgccttcaatcttgttacttgttattattctgttcaggtttcaaatttcttcatggttcaatctttgtaggttgtatatgtttaggaaattgtcttttcttttagattttccaatttattagcatataattgctcacagtagccactaattatcctttgaatttctgtggtatctgttgtaatgtttcttttttcagcttagatttatttgggt

SEQ ID NO: 392891 - DNA, 334 bp, Homo sapiens
gaatatggaaaagctgttgggaaatcagggtacggtaacgtttctagattttttctttcttttttttcccccgtttcagctatctggaacagggcaagaaattagcatttgtacaaagaaagtctttgaacaacacacacttggctcaagtattcctcagacccagactccatgcattggactctgtgtgtactaagtgatcccagagtggcttactggagattgacaatggaaaaggacaatttgaaacacgcccgtaggagaaaatggaaacattgtacaaataacataggaacacaaaattcactcttcttttttttttttttttgagatg

SEQ ID NO: 392892 - DNA, 602 bp, Homo sapiens
aaatattccatttcttgatctgggtagcagcagcatggatatatatagttggtgtgcttataatctgttcacttttctagatgtatataatattaatagtttatttaaaaattaattgtcatgatgatatttgatattaggaaaagataaggggtttttgctgtttaacattgtgagagcccactctgaggaggcactgcacttacagtgaagcctccagtcctgtggaaaagataggaattatgcaaataagggcacattggaaactatgaaatgctggcaaatataaagcctatgttactttacttgaaatcatagttgccgctctggtgatagagcctgtttttccaacttcattgaaatcctaaataacaatttctcctgtgaagattccatctaaagagcaagtcataaaatactccaaaaaagagaaataaaatcaagtataattatgatagacaggaaaacagggtgctatgagagagaatgatggagattttcttaggattgggtggtcatgaaaggcctctctgaagatatgacaattaacctaagagcaaaggatgaatagagccatctcacacagagcgggaagagttttt

SEQ ID NO: 392893 - DNA, 273 bp, Homo sapiens
tcttaagagtggagagaaggtgctgacgacattgcatttctgatggcacccacggttagtagatacgcaggtgatcctgatgagcttccttcacagttggaggacagatgctgtaacggtagtaatagtgggtgcataaagagaccccagcaagagtataagtgaaagggatgcagctttcctgaaaacatgaatatcaaaggcggatgctggtataggacacagtcaatcagcttggctggtgatggcaagctcctgctgtgataaaaaata

SEQ ID NO: 392894 - DNA, 355 bp, Homo sapiens
ggaaaactgtgaggagattttaaaaaaggagctaaagtagaatttccttctactttgccagggtcctgggatctaatcccataaaagtggctgtatttacatatactgcccaaaagagggggcaataggcatgctttcgtagacccagctggctgcccatttgaaatctattctttccttcttcactgaagagtcctaaatttgttaggaacatcaattgctcagataaaatagataatttccaaggcacccttggagctaccagtcatgcaacagaggtctaactaatgggatgtaagtacaaacatgcaagtggagcttctggaaactactgttttgttctctttgcgtagaa

SEQ ID NO: 392895 - DNA, 206 bp, Homo sapiens
aactgagcatcgttaatagttggaccaattgatattatgtgcctttggatgtgacgaaatacaaaagctacatttgctttgttagttttcctgtcaaatgtgttaaaccagaagacaaccataaggaaaaatcaggtaagtctggactatgagacattctacaagaaaactggcctggtctttttttttttttgagacagggtttg

SEQ ID NO: 392896 - DNA, 413 bp, Homo sapiens
acccctatcataatgagagcccggtgaccgtgcttcttgctttagaggaccaaaagacctcaaaggcctatgctagtcagctgccatcttaaacgctccagtgatttttagacagactagaaagaatgaaagcacaatggttaaataaacaagtgaatccagtataaatccacccactaaatttcatacaaggactgagggcttctaagtctccaggctactgagccatccttttgtttagctgagacatgcagaagaaatagtatttatgtggtgtcctctatggagcagaaaatgcatttcctactaatttcagtattactaagaaagcagactctcctgcaaaatgcattatgagctcctgcttgcttgcttcctctgctgctgagtttctagttcagataaaagaaagc

SEQ ID NO: 392897 - DNA, 311 bp, Homo sapiens
ttaattcatttatgttaggctgactacacaaaggactctgcccaaaaggaatacagactagatagaagacaaacaggtagtcaattaataatactaacaacaataataactcatatttgttgtttatcaggtagcaagcattgttctaagggtcttaaatgaattagtatttattcactatgacaatcttttggggtggcataattataatccccatttcagagactactaatatcttgcctaaggttatacagctgtgaaacatacaccagagtaaactggatacaaacctaggatgtctaactgaactc

SEQ ID NO: 392898 - DNA, 174 bp, Homo sapiens
agtgtgagaattaaaagttaattggtaatgcccggcatatggcaagtactaagtgatagctgttaattttccatgcttgacataaactttacgtaaaggttacttttctaggtttgtttgccaagcaccttagtttgttttgcgatttcaaggagaacaatttggtgtataatg

SEQ ID NO: 392899 - DNA, 699 bp, Homo sapiens
taatttttaaaactttcattgtgcacatgagctactcactgccttgagttcactccccttgattcagtgtgacagagtgatgcgctgctgcacagttgcatgtattgagatgtgctgctcttcccggtaaaaagtgagaagaatttagagagaggggaaagggtagaggcttcacctgagctgagggaggcctgactccccagagcagccaggcaaatctgttggaaatggctcagtgttaaaaaaacacctttaaaatggttagccttatctttctttggttggctagaatggagctactaatgcttatttgacccttgaaggacgcttgttcttttcagaattggtctgggtatcatactgtggttgtgggtctgattacctatacaaagggttctttttagtttgcatttctgggcaaagcagaagaatgtgtagtaggcatgtcctctgcttagtaaacattgggtagcactttagagtgcttttctcttcacaccgaaatgacttcccccagcttctgtgtacctgcattagaggatcagtttgggcggaactggaaatctgtcttctggctttctgttcagtcctcctgacgctgtttttttctgatgtatgtgtgcttaaaggctcagaaaactaagattagaagcgaattctgagtcatcacctgttcttattaacctgtgaatgagatag

SEQ ID NO: 392900 - DNA, 291 bp, Homo sapiens
caagctggggtctgtggtcctgagaaggcaaaagaatctatctttattcttagaggaactgcctgctgctggcagagagacagttggctcttgaaagcataatccttagaatattttatttgtagttaatacatcagagcagagacggcagaaagagaaaaatcgctaccctgggactaagagaagagtcccatcagcccagcccagccaacaggtgtatagtaaccagctcccaacaaacttcagtggggaatgcccagggagaggaagtggggcggggatgggctcccg

SEQ ID NO: 392901 - DNA, 366 bp, Homo sapiens
gtgtcacagtgtctgtgctttgcagcaaattgcttgacttgagttttttccttctaagaagcaaagatattggaaacaggagtgccaaaatccctaaaattttttaggttctttgtccgttggatgattctaattgcatgcccatttttgtagccaaggatgtaatttccctattcattggggcttctgtcaggcaacaatggaaaagaataggatgtgaagcacaaacctatctttatagtttgtcatttctaccagaagatatcatggcatatataattaaaaccaatggcaaaaaattattttgactacctgtggcttgaatgtacttactctatccctgctcctcatgaatatgttaaacat

SEQ ID NO: 392902 - DNA, 693 bp, Homo sapiens
taatcatccaccttcactatactgttgttctgtctgctttgggcagggtgtaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtggg

SEQ ID NO: 392903 - DNA, 217 bp, Homo sapiens
taatcatccaccttcactatactgttgttctgtctgctttgggcagggtgtaggagagagaccgtgtgccgtggggctggtggcctgctcagggacagccatggggacctggcagctcaaaacagatggcagcagaacaaaagaaacttttgctttggaagcacacgcacacacacacacacacactcactgcggagaaccttgtgcctggctcaga

SEQ ID NO: 392904 - DNA, 815 bp, Homo sapiens
ccacgcctaaggtccaggtcccagggctttcccttgcaccttcatccctggccctgcagaggcctgcttctcgcttccggggtcgccagagcgcccctcccgccaccccgccatctcttggccggatcgtgcgagagaaggggaggaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactagccctgtctccttgccaatagccctgtgctccccagccccctcccccatgcagacggctgctatgacatccctgttccttaaagtgcggggttcctcgcttgcttctcctccctaatggcacctgtgcaaacctgctgcagagaacagtgtcttgggcagtgcgataagttctccaggttacaaa

SEQ ID NO: 392905 - DNA, 425 bp, Homo sapiens
tcacccatgacccatgatgtcctcacagtcactcctactctaaagccttccgtgaatctcacaaaattaatactcacttcctctttggagctctgggagtagtagttaatgtctggattttcttttctcatctataaaatgagatcactattgtgccatgaaatgaatacttgacagagtcaaacagagaggataatcacaacccacatttttttttttaagacggagtcttgctctgtcacccaggctcaagtgcagtggcacgatctcggcttactgcaacctccacctcccaggttcaagcgattcttctgcctcagcctcccgagtagctgggattataggcacacaccactacgtttggccaatttttgtattcttagtagagatggggtttcaccatgttggccaggctggtcttgaac

SEQ ID NO: 392906 - DNA, 671 bp, Homo sapiens
acaaagatgtgtcagaatatctgttttaaaataaaatattgtatgtatgtcacatttaaaaaatctgatattgatctctaaagggacatttgtgttgtttccaggaattgtcttttgcaaataataattaacatgcatgtgtaaatatgtaaagtcctgcctcggatatttttggtatattttggatacagtgatgtggtaccatgtgtgtgtccatattttttttcttaagcctttgatgttgtattcaaaaagttattgttgagactagttgcataaagccttcctcataaatgtttatattagatttcacatatgggtaagatcttttgtatttgtctcagtgtatcttttatttcacttaacgtaatggcctccaggttcattcctgttgtggcaaatatcaaaattatattctcttttgtagctgaatagtattttgttgtgtatatataccacattttctttattcatccaagttttggacacttggattgatcgaataccttggctataaatagtgttttaataaacattggagtgtagatttctctttgacatactgattttgttttctttagctacaaacaaaataggactaacgtatgttccagcaatcccatttaattaaaaaattaaaaatagaacctgtgatccagcaatttgaattt

SEQ ID NO: 392907 - DNA, 263 bp, Homo sapiens
gcatagccactgcctgttagatgtcatctatatgaccatgggctcccccaccttccttctcttctatggtgggttccctctctcagtggatggcaccaccatctatctggccacatctagaaacctgggagacagtcctcactcccttcttcctcacatctgattaaatcctcaaatctgattaaatttgccttgtgaacagttttcaaatccactctctcttctccaaaccttctgtctctgccctaacccaggcctttgtc

SEQ ID NO: 392908 - DNA, 183 bp, Homo sapiens
cctctgtcatcctggacagcagagacttctagaagtcagatgcaggaagtgcttcccagagcaagattgtctttcattaactgctggagacgtggggcagagactcacccaaggtctgcagcaggcctaagccttgtcccttgttgtatccagccctgtatgcgtttgtgtgcgtgtgtgtag

SEQ ID NO: 392909 - DNA, 493 bp, Homo sapiens
gtatccgagcaccagtcttaatcaaacatcatgtgcttattgaggccaagtgcagctcggcctcagtgtactttaaatgcctcacaagcccttgaaggagaatctcactcaatgcctggaggcattcaacccgccactctaggatcccatcactctcctccctcacaaagaccctggagctccttcaataggacactgctgccatctcagacagctggagacgctgcccagaaacacagccatgaggccacgggatcatcacactcaccctgctatgaggaaacggcccagggttcacaggactgaaagcttgtccaagaagcctggccacagccagcattcctgctcccctaaggctgctatctccacacagctggcgatgggctccccaggaaaacgggttaccaggcccagatatacaaattcagatttgcaaaagggaagaactgagagatatcacataaggacccttgccccccttttttttttttag

SEQ ID NO: 392910 - DNA, 490 bp, Homo sapiens
agggcactaatggatctccccagagcaggctgggacatcccaagatacctgaggagttggtgccctgagccccccgcgcctccagcccatgacttggagctgatcaaagtgggagtaggagtacctgggtgcatgatgctttgggttactttcatctgaaatagcagttaatcctcacagcctcacctctaccctgcttcaccttgagtggcctggaacagtaagaaggtcacgagctccctctgctgaagcccacagaagggcccacccactgtggaagagctggcttcatctctgagtatgctggggtcactctggatgttggaagcctgggatcaggacctgaggtctgctagttacatgtccttgcctttgtgctgctgtgggcagaacaaaatctagttctttcccttttcatgccactatgtaacacagtctcaatctggcccagaaagatgaaaaaaggaatataattcacaaagtaaaatga

SEQ ID NO: 392911 - DNA, 283 bp, Homo sapiens
ggtaacagagcatcagcattcacagagaagagctataggggaaacaagaaaaaatatagaaaacacagcatcttaattatttaattcatgtgttttagttcattaaacatcaagaggaccaaaattaagcaagactaaaaaatacctaaatatcgtaattgataaggtagaaatatgtgtgtgtatgtctgaacataacaactcattcttttttaagtggcaatgaaacattcataaaataaaaaaaaagaaattccttaattgctataaaagtattcctggg

SEQ ID NO: 392912 - DNA, 387 bp, Homo sapiens
gggctacccctctgtgggactgcactccttaccttgtttaggctctgatacttccacagtaggcagccctcctacacagatgctctccttaccttgctccttagcatgaggcaagtgtgcctgccttacttactctgctttgcctaattagggccaaattgttcaggaagaagagttggaaataacttttcctttttctttcttttttgagtcaaaatctcactctgtcacccaggctagagtgcagtggcgtgatctcagctctgcaggatccgcctcccaacttcaagtcattctcctgcctcagcctcccaagtagctgggattataggcacatgccaccatgcccagctaatttttgtatttttagtagagatggggtttcac

SEQ ID NO: 392913 - DNA, 196 bp, Homo sapiens
cggagagcactgtgattggtctggtttgagttctacgtccttctctgaatcagttgctgtgcctagaggtgtggagtaatctgatgggctaggcctgggtcatgtccttacccctgaagtccaggggaggatcttgccactcccaggaccatgtggttttggaataactaaagagattgatcccctaaggaagcaa

SEQ ID NO: 392914 - DNA, 440 bp, Homo sapiens
ggtgtttggggaagccaataaaacatttcatgtgtgaaggctctttataaatagtaaagggctataaaaacatcgattatcattaggactaatgatgcagcccttgtcagcagtaaccatctgttgtggctgtcactctcaaaagcaagatgcgaaaatgacccaaaggtatttaaattacgttcaccttgagttttgttcccatatgactgtttttgtttgtttttggtaggtaagctgacactatggttagggtttgagctctgtccttggagccattgaaatgtagagctggaagggacactagaatcaccaaattcccctcttttaagttgtagcttatgaagtttaactgacttacctaagttaacagagctgcttcaaggtataaccacaaagagttttgcttaaactctgatttgtataattaggactataat

SEQ ID NO: 392915 - DNA, 792 bp, Homo sapiens
aacgggtacctgggtttgggggcatgcagagtatgcccatggaggtgcccatgaatgccatgcagaggcccgtgagaccaggcatgggctggaccgaagacttgccccctatggggggacccagcaattttgcccagaacaccatgccctacccaggtgggcagggtgaggcggagcgattcatgactccccgggtccgtgaggagctgctgcggcaccagctgctggagaagcggtcgatgggcatgcagcgccccctgggcatggcaggcagtggcatgggacagagcatggagatggagcggatgatgcaggcgcaccgacagatggatcctgccatgtttcccgggcagatggctggtggtgagggcctggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgaacaagatgcgatgcctgcacagcttcccaactaggaacagcagggatcctccagtggattcatcatggaggcacatgggacacctacacaaagccaatgtcaccacggacaatgggccaa

SEQ ID NO: 392916 - DNA, 482 bp, Homo sapiens
gagagagatcccacacatggccgagcccacctcttcatgtcgcccatgaggtagctccatccacagggcccagatccctcgcacacatggcctagccctcctctccatgtcacccaggaggtatgctccatccacaggggccagatccctcccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgaacaagatgcgatgcctgcacagcttcccaactaggaacagcagggatcctccagtggattcatcatggaggcacatgggacacctacacaaagccaatgtcaccacggacaatgggccaa

SEQ ID NO: 392917 - DNA, 502 bp, Homo sapiens
ggagcctcatagtttttctccagcctccacccctccagactcgcactttatcgcccctctcagggctcggtcaggaagagtttcggaagctgagtggtggtttcttcttttggaccagccttattgaaccctgtcaggaaaagatagtaatcacggcaaggaagtagactgtttgcaggagaacaaaaagcaggggagggagaggacgaggagaaaggaaagcaagtgtgaagggaaaggagttgctattctttctcagagctaagtcatccccaaagaatgccagttgtgtctgcctggcccagtgcaggggggagcaagttcttgaagcaaccttgagaatggccattttagcagtggaatggagagtttgagcactccagtggggaccctcttcccagctcttactggaagccccaccttaggtagtaggagaaatacatctgcccaatatctcctttcagatgatccagtgaagattatttgttaggaaacgggctag

SEQ ID NO: 392918 - DNA, 342 bp, Homo sapiens
agggcacctccacagggcatcttggagggtgtttctctgcacctcctctcagaggcgtgggggaatcccgtgtccggtgactgagtttcgtctatgataatttgcactcatttctgcccctgcattgcccttcatggacattgtaaacctgatgtttctaattgtaagaagggtgccttccccactgccgtgatggttggaggatagctcacacctagtctgcgatgacctgttagggcccagtcatgcaggagggatccccccactcctctcaggccccccagccagcctgctcagtgtcccgaccactggacagttctcggaagcatcctgaaccctccc

SEQ ID NO: 392919 - DNA, 313 bp, Homo sapiens
aaaaggtgggaggtgggagggagagcattaggacaaatacctaatgcacgtgggtcttaaaacctacatgagaagttgataggggcagcagaccaccatggcacatacatacctgtgtaacaaacctgcatgttctccacatgtatcccagaacttaaaaaataaaaataaaatttaaaagaaaaaagaggcacaaaggaaactgtgtgccccctcctccaccatgtgaggacacatagaaggtgccatctatcaggagcagcctcttaccagatactaaatctgctagtgccgtgatcttggactttccagc

SEQ ID NO: 392920 - DNA, 108 bp, Homo sapiens
tccactgtgaggcactggacaacaattcttagaaccatgttcatccgtacagctgctagtctgggaactgcttaataatagatcccaagacacaaaagcgttttcatc

SEQ ID NO: 392921 - DNA, 369 bp, Homo sapiens
tagggaactgcaagccatcctgcaacctcaggacacactcagaaacaaccacgtggaccacatcacccaagctcagctgcatggctctccgttggggtaggacaaggacctcttccaccaggctcaactggagtcctatccctggtcccaggaccacaaggagcatctctttttttggaatcacactgctccattcgaaggacagccctcagttctctgtcttcaaaagaggctgcaaatggtgctgattggcagggagccgacagcagcaacaccctctacaactttaaaataaaaatgtctcccagggtgggatattatgctgaccctacctaaaagcacattccctagatgttgcttgttccgctg

SEQ ID NO: 392922 - DNA, 410 bp, Homo sapiens
gctttatgataaatcttgatatgtagtagtgtaactcttccaaatttattttccttatccaaaaataccttggttatttaaccctttgctttatttaattctcatgaaaagcctgtggtatgagatagttttgatttttatctccatttcacaggttggcaaactcagagaagtaatatgtccatggccacacagcaaccaagtgctagggagggattagaatccagatttgtctgcttctaggcctaagaactcaagtgctatatgtactacctccttaatcctaatgccaaatgaccccgtcagggtatttaatatgaatgcattacaattttaagaaattctcacgttctaaatcattcatttgcggtgaaaaaatcttgtttgggctgtgtgtggtggctcaggcc

SEQ ID NO: 392923 - DNA, 635 bp, Homo sapiens
aggctgaagtctgactctcaggttggtatatcctgcaggctcttgggacaggagctcattctgtggaccgcactggagaaacagaggctggaaggctttgtcctccccacctgcccccatctgatgtgagatctgaggcagggccactgtcaggcctgggattaaacatcaggtaaaacacaatgatgtgcaaagtcccctgagccctatatcagtgccatgagaaacatgagtgtttcggatacactttccctcatggcatccagcactcaagaaggtctttaaaagagaattgaggaaagtaacatcatcctgctttgaccttcttccaagttaagtgagagcattctcaaattaattagtaatatgataaataaaacatcagagaattagcactttacatttattaaccaggcaaaaactaaaaggctagtaatacctggcaaagatgtggagataagagcccacaggcatggctggaaagaatgtagactggaacaggcattctggagaaataatttggctgaacttaaccaaagtaagtatgtgcatatgctatgagctagaaacaacaacatttcagaaaacttgagcagattggagagcatttgggagttgataagagattcccaatc

SEQ ID NO: 392924 - DNA, 655 bp, Homo sapiens
tgcagaagggatggagacacttgctgagcctatagtagtagttcttaactttgactgttccatcagaatcaaacggaattgaccagctgaccagctggctaagtacccaaatgtgtgtggtgagggtgagacttaaaaacagagctcaacatctgaaatctagaaaaatttggtgccagtgttcttcatacgaagttagtgatgcgctgccagtattgcaacagcatcctcctgggacacatttctaatgatggacagtctgtatctgcctcctgccagctgcattgcaaacataatatgctctttgcagtttcaatcaaaatgaaattcttcatggaaaactgtactgtaactggaagtatttgaaaatcaaatgcttcacagcaggaactgtttctggcagcttggtgaaccaagaaaggcaatattcttctgggaaacattgccttgagagacacaacatgaattacaacatcatgatgtattcagccagatgtctgcaagacagaaaatcacgtgactgagcaaggcatgtgaatgttcttaaagggggagaaatagaaaagaaaaaccaaacatgcatcagatatttcctttttgcatcacattattcccaatcatatggatgccttatgtttataacttgccaattatg

SEQ ID NO: 392925 - DNA, 383 bp, Homo sapiens
accccttatatgaggcccagtgagatgacacttggtagaggagcgggtcagcaccaaggcaggacaagtttagctcttgaatctgggcaggccaaaggagatttcaagaaaagaagacattgagaagagaaagcaaaagagcattacatgaaattgcatttagctggggagacagagcaggtgattatctggaaatagcaggagaaagccaagaggaagaaagagaggaaagcaaaagatgattcatgtttgtcaggaaagtgaatgcagtcactctccctgaagaagtaagcatggactatataggagcagataccaggaactgggccatgctgccaaaacctctgctgtgccttgcccactctgtgctgtcgccactgcag

SEQ ID NO: 392926 - DNA, 334 bp, Homo sapiens
gaaaatttaaaatcatgtgccctcaattttcttggccaggtgtggtggctcgtgcctgtaatccaagcactctgggaggctgaggtagaaggattgcttgaggccaagagttcgagaccagcctgggcaacatagctagacctcacctctaccaaaaaaaatttaaaaattagctggggatggtggcacatacctgtagtcccagctacttgggaggctgaggcaggaggatcgcttgagcccaggaattcgagattacagtgatctgtgatcaggccactgcacaccagctggagtgaaagtgagaccctgggtctaaaaagatttttttaat

SEQ ID NO: 392927 - DNA, 799 bp, Homo sapiens
tacaagtatatttaaattatgtcaattatgtttctgccaaattttagcaattgttagagtgtaagtataatcaatataaatataggaatgtgtgaaatacttcacatgtagacttccacaaagatttctcatgaagttagtgtgagataccagggtcttcctgattagtacttatggctgtgacctcaggcatctttttttctccatcagatggaaaaactgatgctctaactctcagatatggtcatagcatccacaaatagagagtggccatttgtggggataactgaagcaaataattgtcttcattgtcataggtgacagtttatttgcaaccagaaacttgagttctgtttttgttcattgagagagtgccctgagttgtaatgttgatccaagttgaataatctaagcagaacacttaacctaatgacaataaggtttgtagaagtcattttcaaactctaaaatcatgtgattgatgatttttattttattgaagatttgaagcaattaccttgctgtttggatgtgtacatgcctcatacataggtagaacaggtaattatgtgccctacttttgtgccacctttatagatttgcacacataacactttattgtagtacctgtcccctcacaggatagactttttttattctaaaaactcagagatatacagcatacatgtaatagacactttaaatctagcaaaaaaaaaaaaaaagaggctaatgcaacacactcaaagtacagcacttgatattaacactcagtcttactgtaacttttcctacatta

SEQ ID NO: 392928 - DNA, 280 bp, Homo sapiens
ccatgctcatgctgctgtactccagcctgggtgatagagcaagacattgtctcaaaaataaacaaacaaacaaacgaagactgtagacctcatctcagatttatattttagattctaattccttaacattttcctcttggttggcttgagcctgtttttattatggggctacaagcatggcagcaggtgaaataatgccaaccaaggcgagagtcttaaggaaaagacaaaacaaaacatttgtactcctcagtccttagagccaagaaggtagactaag

SEQ ID NO: 392929 - DNA, 528 bp, Homo sapiens
  misc_feature (379)..(379): n is a, c, g, or t
agagctgactccatccactgtctccagttctttcttcccattcccatcaggctttgtccccactgctcccctaaaactgctattgttaaagccagcaatgtcttcaactgtgaaatacccaaaagccaggtacaggaagaggtgctttaaaggaattatctcatccatttacttatttctttttaaaattttttaaaattgaattttaaaaagatggaatgcttcacaaatatgcatgtcatccttgtccaggggccacactactcctctctgtatcgtttcaattttagcatatgtgctgccaaagtgagcattatttgtttatttttagacagggtctcactctgccgtcttggctttcataaaagtctggtaaccnatattattgattaccagacttttatgaaagccaaagaccgcttgctagtaggaaaaaatttcaaataataaccaacgctgaaaaatggtctgtcataaattatttccccggtaatttttgaaaggaaaaattataacaagtactattta

SEQ ID NO: 392930 - DNA, 420 bp, Homo sapiens
atgatgactcgtctgtgtgacagcagaatgaatgaccacagcagagccagagggcctttgcagccctgttggtctcaaatttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtatttgagaccagcctgggaaatacagtgagaccttgtctctacc

SEQ ID NO: 392931 - DNA, 158 bp, Homo sapiens
catatggctcaacctaaaattataatcaaagctgaagtaaaaaaaaaaccaagtgtgggagtttaattacaaatcttcagagctctgaacaggaaagaaggaattacatggagacaaggagagacaatgaaattggacattagtgaattacatgcaag

SEQ ID NO: 392932 - DNA, 769 bp, Homo sapiens
cccctcacttgttctgccttctctactcctaggacctttgattcaattagctggttctcagaatcctgggcatagctcaagcctgagtggctcttccagactctcacccaactgaggaggttggatgatgcgccattttccgctgcaagctgagaagcacctctgccaagaccaagaggtctcactggtggagatgcactagaagtatgtgactctgagggtcacagagcttgctaaacaggctgtctaccatctttggcaaaggcaggaaacaattacactgtaataatagttattaatggccagatgttgcactaagtgatttacatacattctctctaatcctttcaatagctcagtggggtgagtagcagtatcatccttttaaaaatgaggaatcttaggtcttaggttaattatggatgctctaggatttcctggataatcactgaactcactaatcaagggctacatatctgacaaatatttcagacattaaaacatttgataataaaggagtctatggtattatttgtccacatgtaactgaataaagaaacttgttaaagaaaggagaatggcaaaaatgttatatattatccttccattattaatgctagtttaaaagcttgaaattgacaggcaactcagtattttccaacatgcatcacattagcttttaattcattatctgtctttattttttactgtctcctttcttgctatggtcttcattttatactggcgctgaagagacatctgaaaggat

SEQ ID NO: 392933 - DNA, 387 bp, Homo sapiens
attgcgttactgtgacacagcaacaaacccagtctaaacacaggcacagttggttctggccctcaaacagcactagcgggtgaatgaggggcgggatgaggggacccaggcctagtcatgccactgactcccctgctcctccaagctgtcaccaaagcaccccaatgctcatttcctccaatgcaaaatgaatacacaatgacttttctttcagcagcggtgactcccttgtctagtcttaacgggtacacacgtggtcatgacgaaaatctgaacaaaaggaaaaaattccaattcccacttcccacccacctataactggagatgtgggatagaacagattctagtagggcctgcagtctcatgtggcaggatctggctttttct

SEQ ID NO: 392934 - DNA, 223 bp, Homo sapiens
aaaatcccctgagcctaatttccctcttggtcagttccagtagcaagagagatgcaagacagagaaggatgtaattatgcagtaaacatttattaagcacctactgtggtctagacacagatttcagatatgggtgagacatgatatggagatgaaaagaaccatgagaaataactagccagggctgggtgtggcagctaactcctgacctcgtgatccacct

SEQ ID NO: 392935 - DNA, 1036 bp, Homo sapiens
agtatgcaagaattgattttggtaaatgcacacacgtcttccatcaactttcaggggtagctctaaaattaatcacatactgctataaaatataatcttttgtatccaaaatcttcatctaactgaattgtaaaataacttctttaattattattattattattattgagatggagtctcgctctgtcgcccaggctggagtgcagtggtgtgaacttggctcactgcaagctctgcctgccaggttcacaccattctcctgcctcagcctcccgagtagctgggactacaggcgcccgccaccatgcctggctaagttttttgtgttttttttagtagagacggtttcaccgtgttagccgatggtctcgatctcctgacctcgtgatccgcccgcctcggcctcccaaagtgctgggattacaggcgtgagccactgcaaccagctggcattgagttctttaagaggtgctttcaaagtgccatttggggctgggcgtagtggctcatgcctgtaatcccagcactttggtagtccgaagccggcagattgctggagctcacgagttcaccaccagcctgggaaacatggcaaaaccccatctctacaaaaaatacaaaaattagcccggtgtggaggtgtgtgcctgtatgtagtcccagctactcagaaggctgaggtgggaggatggcttgagcccggaagtcagagattgcagtaagccaagattgcgccactgcactccagcttgggccaatagagccaggccttgcctcaaaaaaaaaaaaaaaaaaaaaacccaaaacggaacaccaagtgccatttggagttcctctttctgtttagtagtcttttgattaatgtgtagtatgaaaacacagtcactgtgctgcaaagagttatgaggataatacagtgtaaagtgagttagtacagtattcagcgtaatggtattacatattaatatcacatgctaaatgtgatagaaattataagtacaaaggaagctagagaacgagaataaggtggtctggc

SEQ ID NO: 392936 - DNA, 743 bp, Homo sapiens
ggagaatcgcctgagcctcagaggtcaagggtgcagagagccaggattgtgtcattgcattccaacccaagtgacagagggagaccgctgactcaaagagagagagagaagaaaagccacattctttgaaaactgacttaaatcaataataaatcttaacatttaagagttgcatacgttgctcgagtctggaaaacattaacttagcaggtaattcaacacagaattttcagaccaggttcatcattatgggaaaatgtcagcacaaacagccaaataagtcttttgctggagaaaatcagcttttggattcgagttgaatgcatttataaatgtttctctactccaatgtcagagaataaatgattcataaaaatgggcatattagaaagcctgggcctaggaactaggctggatttgcttcctgacctggctctactatataaaaaacccagctgctttttcactagagatttataataataccaaacttacatgtttgctataagcattatatttgacatatttaaagcatctgggttatcttaggggtattcaatgacagccactgatattacagggacatttgagctgtaggtttttggcatgttccatgagttttatgtcatgcttaatccttttccacatttggaaaaatatcctaaagcgggtaacccggtattactcatataatcaaagtagtctgtgctaaggcaaaaatacaaacaaaacaaaattaaaat

SEQ ID NO: 392937 - DNA, 387 bp, Homo sapiens
cctttccccttaacttgggaattctgggtaagcagcaaaaccctgcctagccatccatgggtaacaagaagtcatgcttgggccagactatacagctgatgtccagtgtgtgactccctaagtaaaacaggttagatcccatccatatgagagaaacagtttttcagaatatggggaaagaaaagtaatgttattagaaaaatcaaataaggaaatcgtgggaaaatgtaaaattactgatttgtcaatcttgtcttcaaatacaagataatcttggggacaagactaaatattttactcagcatctgaacaataccaagaaaaaaaatactgccctactgaagaacaccatttatagctttaactttgtccagcacacatttcagc

SEQ ID NO: 392938 - DNA, 150 bp, Homo sapiens
tctactgggaccagtacgtaatttttactatatgttatattacctttccaaaatctaaaaatcctaaaccctgaagccatctggctccaagagtttctgataaaatatctgtaattgggagcatgaaaaagaataagattacctagggag

SEQ ID NO: 392939 - DNA, 623 bp, Homo sapiens
  misc_feature (16)..(16): n is a, c, g, or t
caacgatggtcctcangctacttgggaggctgatgtaataggatcactggagctcgggaggtcgaggctgcagtgagccgagaatgcgccactgcactgaagcccaggcaagagaatgagaccctgtctcaaaaataaaagaccaaaccaagagcatatgtttacactatcctgtagtctcttaagtgtgcaatagtattatgtctttttcttttttgagatacggtctcgctttgtcacccaggctgaagtgtagtggcgtgatctctgctcactgcgatctccacctcctggattcaagtgattctcctgcctcagcttcccaagtagctgggattacaggcgcctgccaccaggcccagctaaattttttgtcgttctcttagagatgggatttcaccatgttggccaggctggtctcaaactcctgacctcaagtgatccgcccgcctcggcctctcaaagtgctgagattactggcgtgagccactgcacctggctactctcttgatgttgccttctgtgttggggcacaactctgcacctttgtttctgggaagctccattggctagggtgagtttgttgtttttttccttcagatccaccctcctagttggttttg

SEQ ID NO: 392940 - DNA, 374 bp, Homo sapiens
aaaaaaataaataaaaatttttaaaaaataggagttgaggagcaagcgttttctagtggaaagatgaacacatcagcacatacaatgtgatgtgagatggcaggatgacatgatgtatgttacaccctcagcttgggagcaccttactgcctgggccagtctggggccagtgggctactatcagtactttccaatagaaccatgtgctatgatggggatgctctacatctgccattcagtatatcagccacattgtggcaactgggcacttgaaatatgactagtgtgaattacaagtttaatttcatttcattctggtgaatttaaatgcaaatggccctgggtgccctgtagctagcacattagacagtacg

SEQ ID NO: 392941 - DNA, 484 bp, Homo sapiens
  misc_feature (240)..(240): n is a, c, g, or t
ggggggtggatcacttaaggtcaggagttcaagaccagcctgggaaacatggcaaaatcctgtctttactaaaatacatataaaaattagctaggcgtggtggcatacgcctgtagtctggctacttgggagggtaggggttcctccatgtccttacagccctacttatattttttattaaaaaaaaaacacaactggttttttggagacagagtctcactctggtggcccagggctggnacaacaaggagcaaaactccatcttcaaagacaaagaaaaaaaaaaggtatcctaaataggggctcgggcttggggccagccacatcacttttagctaattctttccccttaagggggggtgttccatccaagctttcctatccatttaaattcatttaatgtaagccctttctggtgtcccagttaactctgggccataatggactttatatgggtctaatagggagccaaacagcagagggc

SEQ ID NO: 392942 - DNA, 406 bp, Homo sapiens
agatggttgacttggtaaacaaattagttcaaagcttaaagatgttgacatactctaagttaaagactgaatacaaagcagataggtcagagagaaaactcaatgagttaagaggcatgaaggctcacatagaagtataaatacatttgtgaatgttaaatataaatacttacaattcagtatatttaatgcctgtttttccctgttaacttatgtagacacttcaggtatttcatctttgcttgattttaagtacccactcattcatttattcattctttattcaacaaatagttcctgagtgcaaggcacttgccatgctttttaaccgtgtgagataaataatggcactagctgcagcgggcctgcaaaacacaacaggtgtccccttctcagtgaattagga

SEQ ID NO: 392943 - DNA, 318 bp, Homo sapiens
caagctcatattactccctctgactgtgcccccaaatcccatccaactttcaaggcctagccccttagggaaaccgttcccagcccctaacaatggacatcacttcttcctccatgcactcaatatgcagaagtgaaatgaaatgtttgcttttcagctcaagagaatcgtcagtggctcacgcctgtaatcccagcacttccggaggcagaggcgggaggatcacttgaggtcaagagatcaagaccaacctggccaacatggcaaaaccccgtttctacaatttttttttttttttttttttgagagagagtctcg

SEQ ID NO: 392944 - DNA, 349 bp, Homo sapiens
gggtcaggggctgctggagacatctgacgccaacttcatggccaggagccagcaggtgtaggttaagggtgtgtgtggggggatcctcacgatccttttatctccccttcccaccaggagaaatgcacatctcaggaggagtcgggaggtgctgaatcttggagccactgggtatggcagcggggcaagacattttaaggaggccaaaggcaaacatgttttaagctgcaagccttctaaagctgaatgaacaggtacttgctaagagaggcgaaggttaaacaaacgttagctgggatagacagaagctgagggtagaggccatggctttcagacagaagagcaaatg

SEQ ID NO: 392945 - DNA, 443 bp, Homo sapiens
accacagtgcagccacagctcccactgtgcagaggacacgcttcttcacctacctggcctcatgcatctttgcagcaaccctataacgtatggttgattgttctcatcacagatggtcacttgcccaagcccacttcatcagggagtgacacagctggggttcaaaccgagcccttctgccccaatcccatgctctctacacacctctgcacagcaactcccctcctgcccccgagtgctttgtctctaatcaagtgctttaaaatgaaggctgagtcaaccgttggcttgcgtaaacaccaattttccacggtgaaaaaggtttccttcagaaagatcaatttaaacaaaatactttaagagaaagaaacattctcttagccatcttgcaatatcagtgtgacccacgcctttaaccacttcctcaccatatcaggatccct

SEQ ID NO: 392946 - DNA, 495 bp, Homo sapiens
ttcccattcattgcttactagtgccaggcacagtgtcaaggtcttttcatgtgctttcccttttgatcttcagaacagcctaagatattggcattgtactttttacagatatagaaattcatacatagaaaggtgaagtactttgtccaacagacagcaagtgatagaactaggacttgacacgggtctgtctcatatgaaaatctatgctcagccaggcgcggtggttcacgccttcaatcccagcactttgggaggtcgaggtgggtggatcacctcagttcaggagttcaagaccagcctggccaacatggtgaaaccccgtctctaccaaaaatacaaaatttgccaggtgtggtggtgcacgcctgtaatcccagctacttgggaggctgaggcaggaaaatcacttgaacctgggaggcagaggtttgcagtgagccaagatcatgccactacactccagcctgggtgacagaatgaaactctcatctc

SEQ ID NO: 392947 - DNA, 135 bp, Homo sapiens
catgtctgcacacacctcacacactccctgcacatctcacagacccctacacgcacaactcctgcacgcgtgcctcacacacaccctgcatacatgcctcctgcacacacacctcacatatcgcccctgcacaca

SEQ ID NO: 392948 - DNA, 603 bp, Homo sapiens
agttagctgattttcatttctgttatgattccatagcatgaaaataagtcactttcccaatggcttaccattatagagtgctatgaactttttgtatatgactcttggtgtacgtatgtgaatttctctagagcatatacttaggaatggaattgctggctgcattagtcaggtttctctagaggaacagaactaataggatatatatatatatatatgtgtgtgtgtgtgtgtatatatatatgtgtgtgtgtgtgtatatatatgtgtgtatatatatatatgtgtatatatatatatagtcccacaataggctgtctgcatgctctattaaccatcacactggctgatatggtttggctctgtgttcccacccaaatctcatcttgaatagtaatcccataatccccatgtgtcctgggaggcatcttgtgggaggtaattgaatcatggtttccttcatgctgttcttgtgataggagtgagttctcacgagatctgatggttttataagcatctggcatttcccctgctggcactcattctctctcctgctgccctgtgaagaggtgcctttcaccatgattttaagtttcctgaggg

SEQ ID NO: 392949 - DNA, 528 bp, Homo sapiens
attttttaatgaaaacataacattaacaaaataccctgttgcaaaattttaaaaacaaaaccaaaaagcttattccatgaaggataagactacatataaccagctaagtaattccacaaagtgtaagttattgagcaattacttactattcatgacaattccagtctttatcaactatttggtttgttggtggggagggaaaggggtggggcattttctgctttttatcatgaatcattatttgggctttaaaaaatgcacaggtaaacctaatgaatcaaagttcagttttctgaaaattcccagagaaagcagtcatataattgtgtatttgtcgtttatagctctagattcttaccctacccttactcaagggtagagcaatctaacaagcctaaataattgtaatttcactttcataaatgatctcaaaatttgagctgaaatttcaagccaatttggttgaacttttccagttaaaaactaattttggtcaaaaatgatttatccaatgactcttttacaaat

SEQ ID NO: 392950 - DNA, 334 bp, Homo sapiens
atgagtagtaaggaaagctttactaaatatcttgtacacttagggaattagcaagggataggtgttgtcggggaaggaagtaatgcttaaactcaattctaaatgtccactgggggattatgaggcagctaaagaaggcagagcattcctgggagtggtaactgcctacaaagacatgagagcggagcaagagcactgtcacagcctgcagagcaggcccacatggctggcccagcctcacctgatgctgtcaggggcagggctcacagggcattcctccagcaccgtgggagggctgagcccagcatgagggccgacaccctgaacgggcact

SEQ ID NO: 392951 - DNA, 1035 bp, Homo sapiens
cggggaagacgccaagatggcgacgagtcagtatttcgacttcgcgcagggcggcggcccgcagtacagcaccctcctggaggacgggactttggtctggttattccccgctgctgtgacagcgcccatgacagcagctggtccccactggcacccaggaagtatttatccaatgactcaatgaatctgccgccggatcgcccgggactgctttcactttctgtcagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccgggagagccacccagctgagccccatctggccaggagagccatccagctgagccccacctctgccaggattgccacccagctgagccccgccttggccaggagagccacccagctgagccccgccttggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggacactga

SEQ ID NO: 392952 - DNA, 877 bp, Homo sapiens
cggggaagacgccaagatggcgacgagtcagtatttcgacttcgcgcagggcggcggcccgcagtacagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccgggagagccacccagctgagccccatctggccaggagagccatccagctgagccccacctctgccaggattgccacccagctgagccccgccttggccaggagagccacccagctgagccccgccttggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggacactga

SEQ ID NO: 392953 - DNA, 1283 bp, Homo sapiens
tgtcctggtgacacacaattttctgccacctccacaactgtcggctggtgttacaccctcaacaccctagcacgtttattttgtccctcggcgcctagaaatctcgctagaggggtggttctccccacatatttgtcaccccccccaccaagtgggggggtctttcctcacaaagattcctccagcatgcaagttgtttcacctaccaacaacagtgtttatatacacgccctccgtctcctgccttttaaaaataacgcctcgctattattgggccccccttgtgcacaaaaaaaggggggaccccgaaaaatgggccccccccgggagagtatttttagagcccccccccctttttttttttttttttttttttttgtttttttttttttttttttttttttttgtgttttcctttttcttcatccacccttatatccatgcccttcccaccatgtccttgctactcttccagtccagaagtggagaccactcccccggcccttgcatctgggcttccttgtgccctgccttggacagttggctgcagtggaagtgacgctgtgactgccctgtgcccaagcttaagaggccttgcctgcatctgctccatcttatgggaccctgcctggtgaaggacccaaggctggcctgctggaggaggagatataaggagaagagtcacagtgccccatccaacaggtagctgccctccaggggcagagaagcccagccatggtcaggagagccacccagctgaggcccacctccaccaggattgccacccagctgaaccccacctcagccgggagagccacccagctgagccccatctggccaggagagccatccagctgagccccacctctgccaggattgccacccagctgagccccgccttggccaggagagccacccagctgagccccgccttggccagaagagccacccagctgagccccgccttggccagaagagccacccagctgagcaccgccttggccagaagaggcacccagctgagccccgcctggccaggagagctgcccagctgatccccgcctgcagaatcacaagtgaaataaatgattgttgctttgagtcagaggtcagcggaccttttctgtaaaaagccacatagtaaatatctttggctttgtgagccacaccatgtctgtcacattagtgaaccctgctattgtattgcaagatgagccgtggacaatgtgtcatccagtgggcttggctgtgtgccaataaaactttatttttttggacactga

SEQ ID NO: 392954 - DNA, 479 bp, Homo sapiens
aaaagccagaaaactcaatagaaaaatgggccaagtcttgaatttcccataagatatccaaatgaacaagaaagatataaacatataaaacaatgttcaatcttgttagttatcagtgaaatatacatgaaaaccactaacacagccgggcactgtggaaaatcatttggtattatttactacagttgaacatacacatcccctatgggccagtgaatgcaattctggatgtataaccaggagaaatgcacctgcactcatatatttctaaataacatatataagaatgttcctagcaaaaatatgcataatatccccaaactatcaatgatgcaaatgaccatcaacatcaggagagataagtaaactgtggaatattcacacaacactaggagtgaacttataccaactgctgtacacaacaatatggatgactcataagcatgatgtttagtgaaagaagccaaacaccaaagagt

SEQ ID NO: 392955 - DNA, 1054 bp, Homo sapiens
catttttgattgtcaggtatacatacaactcacaattacacatagttgtcctctggtaactatttgaaacatactgcacttccagtcacatacacagtacttattaatatagatatgtgccaagctcttaatatggaaacagttactgggaagactccttttgatcaccctgaaaggcacatattaaaatgcaatgaaaatgtattcacatatattaaaatccccaagggtatgttaaaaaccccagccatatcttctaaatgacagtgctgctctggccatggtcttaataacaaggcagttcatggtaaactgccagcactgttcagggagtggaagaataaataaattcaagttctaagataccccaaattaaatgtgtcttaaagttcttatatctctaaatgatgagtcagccaggactctcaacgctagaccatacgattccagagtgagagctaaaaccctatctaaacctaacactttctcttgagggcccctttccgtattatcttccagcttcagagcagcagggctcctgcctcccacttctctgtgtgtgagttatgaatgtcttacccctgaggcatggaggaatggtgacttcttttcaagcagtaatgttccttgcccccggtttaaaacgcctgcatttaaaagccttagttgtttcctggcagcattactcacagtagccaaaaggcagaaacaacccaagtgtcattgatggatgatgaatgtaggtgtttcaaaacctcacttttaatgcatctcatattagtaaaagtaatttcacagcagcaaagagaacacgataaattttgcacggtgcaattggtcatcttaaaatcaagattggagattgtgggttcgggcatctgtgttcttggggttggccaattaagttacgtacttgggggaaatttttaagcaggggggcaagggaaagaaaaactcatttatattccagacagtgtattttaattaattatgttactgtacacaaaaaacttttattttcaattaaatttcttaaattttcaattgcatacta

SEQ ID NO: 392956 - DNA, 628 bp, Homo sapiens
ggaattcataatagcctgttttcttcttgcatcaagctggacactcagtggatcctttcaaatctggagacatgaccttcggttctgggaagctggaaggcacaagtgctgtttttacaagctctgaactcatcttgtttctgtccccacctgcccccccacttccagagggaccttgtgactcccaggctatgtatctggggggcctctggccttgaatggttccctcgacatgcagaatttggttgcagcttcctccactctgcctaggtgattactattaattttccagcttcgaaaattctgtaggctggatgcggtggctcgcttctgtaatcccagcactttgggaggctgaatcaggaagatcgcttgagtccaggaattcaagaccagcctgggcaacgtggcatcgataaacaggtgtttatcgatgccactgaaggacttttcccagtcttcagtggcacttcccaagatctcccttcccttgtgctctgtgctgattttaggacagctaagatgactgccatgtgctgtggcagtcctaatttgtcttgttctttcctttccatatcccagtataatctctgttaatcaacaggactaccccaagaacccatgtgct

SEQ ID NO: 392957 - DNA, 721 bp, Homo sapiens
gacttttacttagcataaagacccctttcaactcaatagtagaaaccaaccaattaaatatggataaaatatttgaacagacacttgaacaaagatatatgcatggccaaaaggagcttgaaagatgtgtaataacattagtcatcagagaaatgcaaattaaaaccacaacaagataccactgtacattactgaaaagacttacataacactttgtggggtagttagaactctcatacaatgctggtggtaatgcaaaatgtcacaactgctttggaacacaggttggcattttcttataaaattaatcatcaattgcttctccaggtatttagccatgagaaatgaaagtatatgtcctcacaaagagttgtacacaaatacttgtggctgttttatgcataatagcttaaaactggaaacaacccaaatgtccatcaaaacaaatgagtgataaactgccatgtatccctctcatgaaataatactcaacaataaaaagttatgaaacactgataaatgcaacagcatggatgaatctcagacacattattgtgagttaaagaagccaggctgtatgattccatttaatggaaattctagaacagcaaaactacattgtaatgacagaaagtagatcacagattgattacaaaatgttgcaagggaatattttaggatgatgaacaatttctataatttgatttaatagtggttatat

SEQ ID NO: 392958 - DNA, 563 bp, Homo sapiens
  misc_feature (556)..(556): n is a, c, g, or t
atattttgattgttacagttacaatatattattactgaagagaaagaggttgtgcgttatgctgaaaacaaatctgccacttgagttatattctctgtaaatctattcattttttccttgagataatcaatgcaataactacaagactaatttaatttaggtcttgttagtgtcagcagtatatggtttacttgtttgtttattttaattacatttggcttctttgcgatagaaataagctaaaagacaaaataacttgaaacactaacaaaatctgccttttgaaaggctttggatctggatctggatctggtgctggattaaaaacaacaatcacatcatgcatgatgtgattgtggactcgctggccaaatctaaatcaccctcttccggatgggcgctgtccaataggtcctcttcctccgcaagctttctgtctggccccacgctacttgtgtcctgtgcaaatggctgctccagctcggaactttcttcttttactggctcagatttacaagtttcccccaaaatgtcgagtattttctcattttctggntccaggg

SEQ ID NO: 392959 - DNA, 193 bp, Homo sapiens
tcagtgtctccccactgacttgaggataatgcccaataactgcacacaaagcccttcatgacccactctgccctccttaatagacacacagcttctgcccactgaagaaagcttataccaaattcctttggtttccagatgtagccccttctcttagggttctgcaccttataagttatatttccactgcttg

SEQ ID NO: 392960 - DNA, 246 bp, Homo sapiens
aaccacttatctgatttttattactgtagcttagttttgcctattataaaaccgtacagaaatatgtgtatgtgcacttattttaaatgttgcatacggccgggcgcggtgggcagatcacctgaggtcgggagttcgagaccagcctgaccaacatggagaaaccccgtctctactaaaaatacaaaattagccgggcgtggtcgtgcatgcctgtaatcccagctactcgggaagctgaggcag

SEQ ID NO: 392961 - DNA, 381 bp, Homo sapiens
tggagctggcacttcaaaaatagttgttctatgtatcaataccctaagtaaacagaagtatccctggtacagaaagaaccaagaagaaacaaagtagtggagatggttattggtcagtttttgaattcctgtgcactttctgtcctgggatatgcattgttttaataggctggttaatgtttctctctctctctgtctctccccctctctcacacacgtgcaggctcacatacaattaagtgttctatgaacttttggctacgctttaagtataatttcatttaaagccatgccatgttccaatttgaggccccagatttaatagaatgtgaccttgattccaagttttaagggaggaaaaatgttttacaaactatgcca

SEQ ID NO: 392962 - DNA, 471 bp, Homo sapiens
tacagcagtaatgacaaataatgagtgactgtattcaagattttaggctctaaattatctattttatataagaatttttattgttttgcctgagattatttggtccaccctgctactttggatgtactctactggggaaaatgtagagtggtgtaggaacaaacaatcaaacactagtatcttgaatgaaagttctgtgtgtagtttggacagatatacttacagaagaccagaacactggtggtatatgatatataaccaagacagtaaagaaatgcaacattgcaggagcaaagagtaagtcagacctaaagcctagttccctttaactacacaggtgtagaccttggtcaacacactatccctacctgagtttccccatataaataaatgagattgttggattaaaggatattcaaggacatatgcatcttcaaaattttaattataaaaatgaattgactccagaaa

SEQ ID NO: 392963 - DNA, 788 bp, Homo sapiens
tatgctatctcatacctgtaattccagcactttgggaagccaagggaggcagatcgcctgaagtcaggagttcaagaccaacctggctaacatggcaaaaccctgtctctactaaaaatacaaaaattagctgggcatggtagcgcacgcctgtaatcccagctccttgggaggctgaggcatgagaattgcttgaacccaggaggcagaggttgcagcaagccgagattgcaccaatgcactctcgccgagtcaacagagggagaccctgtctcaaaaaaacaaaacaaaacaaaacaaacaaacaaacaaacaaaaatgtcttacaatcttggtggtctatcaaaatagaaaagaaagaattaagaaattaagcgttttgacctcaccatggcaacaataacgagtagcaacagtccatgaaatgtttctaatgctaagaaactgcatatgttctttaatatatataacaaatctaacaattaaattcaatacacaaatgggactatgtagagtcttcatggagaacattttaaacttgaacttctaacttgaaatagtttgatctctctatctaactacactaacaggcaaagagtgaaaagataacacttgagaggaatgatcatcaacaaggggcactgcaccagcctgatcaacatggtggaaacacgtctctagtaaaaatacaaaaaattagccaggcattgtggtgcacgcctttaatctcagctactcaagaagctgaggcacaagaatcacttgaacccgggaggtggtggaggttg

SEQ ID NO: 392964 - DNA, 353 bp, Homo sapiens
caagcattgaggagctgcgggatctactgcctggaggagaggacggacaaggccagccatgaggagtgcagggagaggagcactttgggaagaccacagtgcacaggactcacacccagccttgctggagaaagcccatgccccaggcttcttccaggcagccccactgtaagacatctcattgcctcttcctgccctgggctgtctgacccactgccccttcccccaggaacacttccactgggatcatgagtcactctgaagccactctgaaatcactctgaagccaaagctgggctcagtggggaaggtcaggaatggagaaattgccttttctcgttagcctcctcttg

SEQ ID NO: 392965 - DNA, 305 bp, Homo sapiens
gggaggctgaggcagaagaatcgcttgaacccgggaggcagagttgcagtgagccaagatcgtgccactgcactccagcctgggtgacagagtgagactccgtctcaaaaaaaacataaactctccttcagcatttttctctgtcctgaaatcactatccagtgtcagtttctctcatgtgcaaatcatcatgtcaggtgttaatagttgaatcaataaagaggaagcccagttctcttgttcagagagtcaaaaaggaatagtatcataattggactcaggcagaaattggaaatttttttagt

SEQ ID NO: 392966 - DNA, 225 bp, Homo sapiens
agacaggtgtggacacaaccacagtgcagacaagggtgagtgccaggagagaggggtccagactgttgggctcttccagaaaccccagaccaggtcatagccactgaaaatggatatatttcatattcaccttttaccctccacccccaaaagggcctatgagatggccctgctcaaacatctagaaagaaagagataggatctggcctctgacggagatgagtg

SEQ ID NO: 392967 - DNA, 290 bp, Homo sapiens
aagtctaaaatcaaggtgtggtcagggccgtcctccctctgaaagctgtaggggagaacttcttagcctcttcctggtttctagtggtttactggtataggggagtaacagtaatccccataggttcttagttggaaagcacctttgttacaaaagacagattgacaagagaaaaccagacagaagtttattaacatgtgtattttgagtatacatggagacaccaagagaatgagtagttttcagaggtggctttgaatttcagcttatatagcatcttcaacaaagaa

SEQ ID NO: 392968 - DNA, 369 bp, Homo sapiens
ctccttgagccagctgaacctgcggcctgctcaccggcaccaaagccctgtaggcccaaaggcaggatccggaacgttccagggcagtccctgccataccccaaacagcccctttatgtggtgcccactgtgggtcctgggatctcccaggcttggatttaaatcctgactgtgctccttagctatgtgaccttaggccagtgactttgcctctctaggcctcagtttccccatctgttaaatgctgttaatgatcattccaacctcagcgggtggttgtgagacggtgaggtagctgccaacaatgtggtttcctgagggctcagatgagccaggcacttggtaagccctcaatacgcctgcaatccc

SEQ ID NO: 392969 - DNA, 361 bp, Homo sapiens
acaggctaggagaaacgaactttgagtagatgacctgggttctaaattctagttctgatcaggggagctaggataaggtgcatggatcccctgagcctacattttctcattttataaataaggagactaaaaccaataatgtctcaggaaacactggacaagctgtttgggctctctagccttggattcctcatttgtaagacaaagaagataatcctaccctattgcccatgttggtgtgggaatccacaaagaaggacacggcactgttccaagtcaaggttacagggagaatggaacaagtttcagtagaagaaacttcacctaacctctttaattccaacagttcttgaatttcctg

SEQ ID NO: 392970 - DNA, 532 bp, Homo sapiens
gctattgtatgactttattggcatgtaatttaattcatctaatccacatgaaaagaaggagtagagaggtgcttggaggcatgttttggttctaatgggagcactgtggtcagtatgttgcagcagggactgtttgttcccagctccacgttatactagctgtggagccttaaagttatttccatctctgagccttgcttttctcacctgtgaagtaaaaatactacttaccttggaagaacgctctgaggcttaaaatgaaatggaatgaaatataaaacctagcatagagtctggtacatgtcataggtccttagtgtcacttcccttcccagtgagtgctgtgaaattgcctgtaaactgtttaacttacttgagaaataaccctgccgacttattttaaaataataatcgctaatatgtctatggcacttaactacattccaggtgttctcctaagctcttggcatatattgatttatgtaatgctcataacaaccccttgaggtaggtaccatgattatctgtgctt

SEQ ID NO: 392971 - DNA, 914 bp, Homo sapiens
ccttattttaactctgaaagatagaggtttacagcaaccaatgcttaaccaggagaaaggcaacttaaatatggtaagagatctctgtggtgttttaacttaccctagctccaacccctccccagcacagggctaatcttgaagacagcagcccaaatttctggtgggggttcctggttagggagggagcagagaagatcttgatcccaatgaattgtgtttatcttttttgactgtctggaatttcccttgaagaactgatgaaagggaattctctttgcttcacgaatctcagaactctctcaaggcagagcagctacacagaggatgttccctgaaaactgctaaagaacaaaagaacaaggaactgctgcctgaagcaaaaataacagttgaggcaaacaactgataccctgaaagactgggaaaagtttggaagtgatatttttgggagaataagggcttcaaaaagttcccatgtgtactagagagagcagaaagcacacccagggtaggactcatgtgcagaaaaggcccaataagacaataagctttcatctctgtctggtctttgggctcagcacaagcaggaagtgaaggctaaaacagagctgtaaattgcctggctaagcttaggagtgactccacacagagccaatctgcaaagacctagaaaattctttctttttcttttttccttccttccttcctttgttttctttttcgtattcttctttattctttttgtttctttttttatttgtttctttcttcttcctttttaaaaaacaaaacaaaactttttttttagtcgcaggcatttaaggaattctatgttaggtcactggctgactactaaaataacaaaatgaagccttcagtgaatacaaagaatacagtcttcaaaaaaaaaa

SEQ ID NO: 392972 - DNA, 240 bp, Homo sapiens
gtcttcagagtctcacacacctccactcaatgactttaacatacactaatccattctgtgatggtgaatacttttatttatattaatatcctcatagactaggttagaaattcagatgcattaacacaaccctctcctgtagatcttctcttgtctagctcgagatggaatgctgtaagtgaggagccatgtgttagtttgttctcacactgctataaagatactgcctgagactgggta

SEQ ID NO: 392973 - DNA, 700 bp, Homo sapiens
cacactaacaagagcatatgttgtcattttaaatatgtatgtataataaattttatatttatagattgacttctttcctatcaaatgcaaagtatttctctgacataaatcacagttagtcttaccttacttgacataattatggttgtaattatttcaataaatattttctctttaacacatatagatacatacttgtataatgttttgagtatatattaattcatgtttacaaacaaatgccttaaaagttctgaatattatgccttgacttaaaacagattcttatgatgaattaatgggttttaactttaatttttgaaaattggtaataaatcagcatcattatggaaattcatcaaaattgctgatttagtcaggttttgaaattcattttttatattatgttgtcatctagcattggaataataaccacaagtttcattaactgagaagcagaaactagaaaatgagatgtaaaccagtgaactgtgaaaatgatgatatattcacatatactctattgaaaatgattttgcattctctgctaatgcagatgtgatatgggattgttgaggtggaattatttaaggggctgcttaagaatttaagcatatatgatattcatacattgactaaagaagattttagtgaaaattattttcttagaatcactgagcattagtacttgaatgaatta

SEQ ID NO: 392974 - DNA, 338 bp, Homo sapiens
ctttgcttctgtgattatggccacagttttgaaaataaagtcatgtggatagagttgtgatttttagggatcaggatgcctcataaaacaacaatgctgtattcttttgtagaacaagatcctgcctaggcctctttcctagtattaatctttggtcatgatgaatgtgctcccaaccatccaacctatccctttgcaaccaggcttttgtgagatcaaataatttttagagttgaaatgaagttattaccagctctaaaataaggtactacaggagggaagtaaggaccgacaagagttaaatcactttctagggttgcgcaggtaactgggaatga

SEQ ID NO: 392975 - DNA, 353 bp, Homo sapiens
tgcccagctaatttttgtatttttagtagagacagggtttcaccatgttggcaagcctggtctcaaactcctgacctcaagtgatctgcccgctgcagcctcccaaagtgctgaggcaggagaatggtgtgaacctgggaggcggagcttgcagtgagcagaaatcgcaccactgcactccagcctgggtgacagagcaagactccgtctcagaaaaaaaaaatgggtatagagggggaaaaagttatgtcaaaagacagaaaaaggccttaatcactatcacaccacttccccaactaaaaaatcttcagtacccctactattccttacttttccatatggaaagtcctctg

SEQ ID NO: 392976 - DNA, 421 bp, Homo sapiens
cacaggaacctacacttagaaaagcgctgggcttggcttaatattctactgctgctgccttgaaattctgaagaattttttaacaaggggtcctgaatattctttttgcactgggccccacagattatgtagttggtcctgattagggtgtagagcaaggtattgcagtaataaagtatttgaatcattccttcctcagaccacccccccacccaggagaaggaaaaatccattccaactgttctcactttatgcaggagcaggtgcttgtgactttaagagatgggcttgcaggggaaatggaacagctcctggaagacatggccttttgagggtgcttaggagatttgagcagcacatactaattggatacagataaaatgctcttcagattttagttttctgctctgtttgtttagtc

SEQ ID NO: 392977 - DNA, 398 bp, Homo sapiens
actgcacaggacagacagaccctgctataatctcagcgaaggagatggataagaagcaaagatacaataagtgatggtgactagatagtgctaagtgctgtgaaagaaagcaatcagggttgcatggcagaatgggacaggatgtgggctgctgttttacatcaagtggcctgagaagcctctctggggtggaggggtctgagctgagagttgaatgagggggaagaagcctatgattttggagatctgaaagaagagtggcttaggcagagggaagggcaagtgcaaaggccctggagcaggactgagccttgcatacctgagggacagaggaccacctctgtggctggagttggtgaaaggaaaggagagagctgcaggcagaagaagagtgggct

SEQ ID NO: 392978 - DNA, 576 bp, Homo sapiens
aagtgatccacagcgttaattatcagggaaatgaaaaataaaaccacaatgagatactgttacatacccaccacaatggctaaaagtataattaaaaagaccaccaccaccaaatgctggcaaggatatggaactctcatatattgttagtgaaagcattaaatgtaccactttggaaaacagtctggcagcttatcaaaaaacctaacaaacacctagcccaagagcgattccactcctacatttttagccaaaagaaatggaaacattatgtccacaaagatttgtataagaatgttcacagcagctttattcacaatagccaaaaacttgaaacagcccaggtattcatcaatatgagaaccaattgtgatgtttatagaaaactattcagcaacaaaaaaatctattagtatctgtaacatgaataaaaatgaagaataaagtaaacagattccatttatgaagtttcagaacaggcaaaacgaatctgtgatgtaaatattcagaacactggttgtcctcccttctcccccaggggaagggaaggtattaactgagcagaggcagagagct

SEQ ID NO: 392979 - DNA, 354 bp, Homo sapiens
ctactacatccattaagggaaaaacgatcttcagtgcttcacttgcccttctgcagtcccacctttacttaatattcagcctgagtatgaatctgcttcttaacagtttatgaagttagtcaagaaggcttaacatattttttattcagtattttaaattgtttttaataggaaggtagttctggcacttaaccattttgctaaaatagaagtcatgctttagatatttttcaaagaattgtcattagctaataactcttagctatagggtgggggaggaaaggagagaaaacacgatcgaacaatctcatctctgactatattccaattcttcccggagagaaaacacgatcg

SEQ ID NO: 392980 - DNA, 875 bp, Homo sapiens
tgctcagagttggatgagcttccatttttaacatgactgactttcaccagtcttcctgggggccccaaactgggtgggctcttttcctctgctccaggccttatctgtgttaggttgtatgattaggatcctaaagtcactgaacaaacagggtaggagtctccataacagaccttttgttcatatacatttcactggctttcgctggagaagtcagagaatggctatcatctccacactaataatatccttcagtaaatgataaagtcaagtccaaagtaaactgagaagctttatcagcatgtcaaagctatccccttacagctctgtacttgccaactgtgcatccttttccgagacaaagacttgatgcacattaaaaggcacttaccagagtgggtgtttgtttgccaaaggagagcaggctgccctctgattccaggcaccccggtcgtcactctcatcagaggaagggaggtatactttacagctagactccttccttgatgatctcctgaatcgagtcagggggagattcagagcttcctgccaagttattccttctctttctccttgttaatattaactgatggacttctcagagggacagtgtatttctcactgtgagtagagagaacgctgtggtcgaccagttactcttccaccctgttgtcagagaagatgcatcaaaagggatttacacacccagttaattctaacagatggcccttccccggtattctgagagaagttgaaaatcaatccacatttctctccaattccaaattaggcaaattagcacactggccttgatttttggtaagcagatttagcaaaatggacacagtgaaaaagaggaaagatgtaaaaaattt

SEQ ID NO: 392981 - DNA, 502 bp, Homo sapiens
cgtggtggcagatgcctgtaatcccagctcctcaggaggctgaggcataaggatcacttgaacccagggagcggaggttgcagtgagctgtgataacaccactgtactccagcctgggcaacagagcgagactcagtctcaaaaaaagagaaccaaaaacttattttagaacttaaaaaatacaataaccaaattaaaaagctcagttgggctgggggtggtggctcacacctgtaatcccagcactttagagaagctgaggtgggcagatcacttgagctcaggagttcaagaccagcctgggcaatatggtaaaatccccgtctctaccaaaaataccaaaaataaattcgcaagacacggtggcatgcacctgtagtcccagcttcttgggaggcggatgtgggaggattgcttgagcctaggaggcagaggttgcagtgagctgtgatcataccactacactccagcctgggcaacagaggtgagaccctgtctcaaa

SEQ ID NO: 392982 - DNA, 285 bp, Homo sapiens
taagacaggaataatccttatactataggaagaaagcaattcagatagtttgtatcagtgcagggatatcttttcatggtttcttttctctcttgtacaaattaacaaggtggttcttcttgccatcacaataaaagattgctagtacttgtgcctttgcttacttgatcctctttgactccattgccctccgttcttttttttttttttttttttttttggggggaaaggggtttggcctttacacccatgcggggggccgggggaaaaataattgctaaacca

SEQ ID NO: 392983 - DNA, 625 bp, Homo sapiens
taaatgatgacaaatcttgtcaaatgctttttctgcatcttttgagatgatatggttttttttcaatctcttcatatggtgagtttcattgatttttcttttcaaatgttgaatcaacttatgtttctagaataataagccatacttgtcatgatatcttattgttttaatatgttgttgacttggcaatattttgttacatatttttggatctgcctgagggctactgatctatagttttgttacatctttggttttgctctcaggatgatgctggcctcatagaatgagataaggtgtttcaaacttttttggaacacttcgtgtagaatcgtggttatttatttatttatttatgttgataaatgtttggtagaattcaccagtgaagctatcttgggtagagattttcttttttgtatgttagaagatttatgattacaacttcaggttctaatagagatacgtgttacctgtttctgagaagctttggtagtttatcttttaagaaatttgtccatttcatctaagttgcttaaaattgttcacagtattcccttattctttcaatgtctattgaatctatattgatgtcccctctttgttgtcattttgtgtttgtttt

SEQ ID NO: 392984 - DNA, 138 bp, Homo sapiens
ccatgcacgtccctggctgaagagctactcttggctggaggcatacctccctggtttccaagcccccgagagcttgagcttaccttgccctgaaagaaggaaaaggggatgctctttaaggtcatggtctgaagccag

SEQ ID NO: 392985 - DNA, 379 bp, Homo sapiens
ttaggacatattaaaattattcattatttatttaaagctcaaatttaggcactggatattttatctagtcatctggtttcaacaccatctgtacactgagtcattatggatttcttaaaatcccacctggaaactattttgattattaggaaaagaatatgccagccaggcgcgatggctcacacctgtaatcccagcactttgggaggcagaggtgggcagattgcctgaggtcaggagttcgagaccagcctggccaacatggtgaaaccctgcctctactaaaagcacaaaaattagctgggcatggtggtgggtgcctgtaatcccagctactcaggaggctgaagcaggagaattgcttgaacccaggaggcgg

SEQ ID NO: 392986 - DNA, 119 bp, Homo sapiens
tgcagtttgatcagcatttcctaagctgttgaacacaactctatgccgatgattttttatttgcttctcaacatttcagctactcaaccaatgtggattgaccacttgacatgagctag

SEQ ID NO: 392987 - DNA, 339 bp, Homo sapiens
aaggatagataggtgccaactgctctccagacactatcgtgattcaaacaatattaaggggtgtagtgctttccttgagtgattgaacccattactggttcctcccagtcataacaacaaatatgttacaaatgttcaactcacattacaaccttgctttccaagggaccagttgatcggttacttacaccacatagggtttaatataggagagaagaaatggaagaatgtctatgttatggctcttcacgagcttactaattcagcctatttgctacaatatctactttgttccattctgcacttaatgaatatttgctgggtgctcactctatgaaa

SEQ ID NO: 392988 - DNA, 784 bp, Homo sapiens
ggcccacagaggggtgcaggaactctcccaaggccacacagccggtgctagaacaaggacacggtggtagaactgaatgtgaacacaggtccacctgacgcaaatgcccagtccttccagcctccacagctgacctccaagtcggacagttccaagaatcatgcggaagggacccaccaagagcacatgtgagttactcagggacgggcctcacctgtcagtgagtggggtgatgaccagccgcggcgtgttgcccagatactcataggaatactggatttgggcatcgcagatgttggcaaagcagtgtcgcttctcttcgtcccagcgatgccggagctgggcctgccaggtgaaggcctgagaactctccacctgcaggatgagccggagctcttgttgccaggtggaatacaagagctagggctgcctaaggaaggccagcatgcctccaaggccggtcccctgctgcccagggaaccctccctggccctctttccccctccagcacccacatccaactgtatggccaccctcagtggaatctcgctacagaatggcacttccaatgggcgggcaccgtcatctgactgctgtgtgttgctcaccaggggtgagtccgggcaaggaggttaggaggcagctgcagccagcaacagagtcagtgccccaggaagaggaagtggcagggtctgaagtccctgaatgcactgccctgaaccgggtcccttgccttcccctggcccctgggacaggggcgctcatgccttggccacgatcattt

SEQ ID NO: 392989 - DNA, 352 bp, Homo sapiens
tgctttcctcttagaattgtgagatgggtataaaagtaaaataatttagcacagtgtcttgtacatagttaatgtgtgagacttattattaagttaaaaagcaaccacattttcacattttgcattttagaaagatattttaaacgtatttcacatttgcctgatgatacattattccttattatgtggtttctgtcactgctgttgtcattcatttgctttttaatatctgcagaatatgaaatatgtctcttttaagttcttattattagtgtgtgtgtgcacacctgtgtgtgttttttcatctgtctcagtaggagtaccgttcaatttggtttttcaaagaaagtaa

SEQ ID NO: 392990 - DNA, 184 bp, Homo sapiens
tgggcaatgtacagagaccccatgtctacaaagaaataaaagaagaaaattagccaggtgtggtggcctgtagtcctagctactcactcaggaggatgaggtaggagaattgcaagtaaatgagcaagtaaaccacagaagaatattaattttctcttttttctgctgcataacaaatgagcac

SEQ ID NO: 392991 - DNA, 750 bp, Homo sapiens
tacaaacccaagtcatttctcacacttttctctctcacatacctccttaacatcctcctattgacaccacttccaaaatctacctcaaatccattctcttctctccatcaccttattaatccaagccaccatcacctttcttgatggcaatggcctccaaatagttgtccttattgccactcttgcctcccttaaattcattttccacagagccaggctactcatattaagatgcaactctaatcctgaagctccctcacttaaacccatctgagaactgccatttctactaaggacaaaattcacatgacatacaaggccctccatgatgtggcccctgtcaatccctcactctactgctcacttttgttctctgttttccagtcacacccttaactgattatttccagcctttacacatgctgattccttcaacctagaacgcttttcccctcattctaattactactcatcctacatgtcattttctcagaaaagctctcactgagcctccatctaaattgggtttcctgccattctttctcaagttgccctgttcttttctttgatataataacctactgtccttatttatatgtttctttaacatatgcctctccaagtagatgataggttctatgaggtattaataaatttgaatttaacacgtcaaaaaactaaactcctgatctcctccccatcagaactagcccttcccacagccttttccacctcagttaatgacaactc

SEQ ID NO: 392992 - DNA, 533 bp, Homo sapiens
ctatctgctcagggacttcaattctctggagcctctagcactggaaggacattgagtaaagtctgtgggtgacttgtgggtgtctgaagtaagagtggtgtcataaactcttaaggctggatttttaaaaattttgtctatttaaaaattctttctttgtacatctttttctattttttaaaaaactaacttagtctacattgtacatattattatacatgtgtccaaacctaagagtgacccctattgtaaactacagactttgggtgatcatgatgtgccaatgcaggttcatcagttgtaccaagtgggccactctgggcagaatgttgataatgaaggaggctgtgcctgtgtggggacaggggtatgtgggaaatctttgtaacttccattcagttttgctgtgaacctaaaactactctaaaaaaataaagtcttaaaaaaaaaaagggctggccacggtggctcacgcctgtaatcccagcactttgggaggtcaaggcgggtggatcacctgaggtcaggagttc

SEQ ID NO: 392993 - DNA, 147 bp, Homo sapiens
gaatttgccctgtaagctgggggaggggtgaggaggcataaccagtgagaagggttgaatggcataaagttaatactaacattggtccagaggaacagggcagagttccctggaggaagggaacctagtcaggagatcggggcaggc

SEQ ID NO: 392994 - DNA, 564 bp, Homo sapiens
tattcccaaggctattgatttatagactggaatgggagaaaggacagcacccagggttttgggtctcccgctggactcctgcttgagggggtggtcttatacagagcacatagggcccccatttaaccccagccagaggaggggctgccttgagaccaagcattcattacccctgtccagggaagtataatgaacagtagaggtcatggaacattctcatgttttattcaactttgtggatcacttcacgtatttcaccacatagacagcattcccttgtgccatatttctgattactttgtgcccagtgaggatccttcattcatttattgcttctttccttcccagttacttgtgtttcttttgtctggacagaagaaagcggtaatgtctgccagtctgaggacagagcgtgtgtgatggtgccctgtaagactctattgaattgagatactgtctgcaggaaggccatttagtctaaaaccagttatcacttctcctgagctaaaaagcattcagttctatcttctggtcactccagaagagattccatagtacaagcca

SEQ ID NO: 392995 - DNA, 357 bp, Homo sapiens
gggtttgcggagctatcaggggtgcctgtcgcatagcctggaaatgtgcttacactatcttctttgcccagtgagcgaagggaaacagaggacacgaggcagatatcatgtgacttaagaacgcgtggaagaataggaaacgtcttctcaaacgtgggcattctcagaccacagaggcttcgggaatggctcttgaagctgttggaaatttagcagtggggaattctaggcttttaccaaacagtcttttctttttttggtggtaaaatagacatggcataatatttgccactttaaccatttgtaagtataagttcagtagtattaagtccgttgatgttgttctgcaaccaccac

SEQ ID NO: 392996 - DNA, 373 bp, Homo sapiens
tttcccttctctctctgcaaaaaggggaaattggcaagtatcacgaggtggcgatgtaagttgtaataaggtgcgaccttctcccttcaatcagcacaggccctggaggggcctgggcagggagggcagcaggacagaagttgcataaagaatttctcagccgggcgcggtggctcacgcctgtaaccccagcactttgggaggccgaggcgggcggatcacctgaggtcgcggagtttgagaccagcctggtcaacacagtgaaaccccatctctactaaaaatacaaaaacttagctgggcatggtggtgggcacctgtaatcccagatacttgggaggctgaggcaggagaattgcttgaacccgggagg

SEQ ID NO: 392997 - DNA, 893 bp, Homo sapiens
acacttaaaaaaataaaataggcctttcaaagggcttgaatttaatgttacttctgaaatgaaatgatatatgttttataagttacatgtttcacaatttcatttgatcttcccaccctcatttttgctacagagccaggggtaaaatcaggtccagggtttctttccttctcacaagaatcttctcatgaactcaagggagaatcatgaaatcttagaaacaatctttttgggaagacaaaacagactcactttcctttgtcatttcaaatagactgtcctgaaatatcctaaaatcacatcaaaactagtaaaaatgagtgtaatcattttcaaagttctgccataatataaacatgtttgagtgaaggccttagctttgcttgtatctccacttgtacacctccagcaatgtaaaacttagtagcaaaggctgcctattctattttgagaccgctggtatttctggcaagttctaaatcagctgctttatatttctcacccttccttagacctatattccctttttctggacccacacgaactaatacctcttctgaaatttatctgacatttgactgaggtaaaagtatgcttgggttacccaggcatggtggtgtgtaccaccagcctggccaacacggcgaaaccctgtctctactaaaaatacaaaaattagctgggtgtggtggcatgtgcctgtagtccagctactggggaggctgagctgggacaatcacctgagcccagggagttcaaggctgcagtgagtcatgatcatgccgctgtactccagcagcctggtgacagaccctgtctcaacaaaacaaaaacaaaaaacataaaaagtatgcttgggctgcgcgtggtggctcaagtctgtaatcccagca

SEQ ID NO: 392998 - DNA, 651 bp, Homo sapiens
atgcaaataaaatcaagtcatagttaaacttgcttatgtcaacgattctgttcttgcaagacctacctggcctcaagagaaattattttccagggcccaacacattggtgttttatcagcacctaattgacctggggaaagcagaatgcctaactccagcctgtggtattttgttatggcaggctgagcagactaatacagactttaatatacagactaaaagtaaagggatggagaaagatacccctagtcaaaataaagaaagtagttatgttaatctaagacagagctgacttcaaagcaaggaaacttattagggataaagagggtcagttcttcaagaagacataataattatttatgtttacatgcctaaaaatagagtgtcaaaatatctgagacaaaaacgtggaactgaaatgagaaatagatggatccactatatagttggagacttcaatactcctctatcataaatgaacagactcagtgacagataatcaggacatacttgcactcaacaccaccactagtcaactggatatgttataaatgacatctatagaatactttatctaacaactgcagaatacacattattctgaagctcacatggaacattcaaaagatataacacagtttgagccataa

SEQ ID NO: 392999 - DNA, 274 bp, Homo sapiens
attgctggaggggcagaagcaatactcattcacagcaatgtatcccattaggaaagctgtaaataaatcctaaagtctaatcatttgattaaagtaattaagatggcatcttgactcttttgaggggtaaatagagccaagatttttttaaagattttatatatatatgcactaatatgtagtacatacatctaagtatatacacacacgcacaggtagagatgaaattttttttaaaaccttagaaacatgcatgtttagctatttctttaga

SEQ ID NO: 393000 - DNA, 385 bp, Homo sapiens
taaacacctcctccacattttcacttgtttctgcctggttcccaggtgagggttgcttgggaggtgctgttcagttccaagatgctaaattaaaagatggagacgagtcactcaacctggggaatgtagaaaagtcaggagaagaaaagctagaagtcctcccttgcatccccccacctattcatgtaagagaggttcctctgtgcctcctctttttcctggggttatccacgacaatgaaaaatccactgggaaaaggcataagaagcctgagaagatcaactgatttatccatgagtagagcattgcaaactgtaatcagctattaaatccattgacaaataaaatattaattgaatgccaacatgtgcaaagcaatctggag

SEQ ID NO: 393001 - DNA, 245 bp, Homo sapiens
aattgggatgcattactggcttgaggtacaatcagaaccttcatctttctggtgtgtggaagagaggctggggactgggaagagctcaggctaagaaggacttgggttgggatttaggggtgagtctcatcagactgagcacttggagagaagtttggtagtttgaatttggagctaagaatctagcttgggcagggtgtggtcgcttgcacctgtaatcccagctaattgggaggctgacgtgg

SEQ ID NO: 393002 - DNA, 569 bp, Homo sapiens
ctgggcatggtggtgtgtgcctgtaatcccagctactcgggaggctgaggtgggaggattgcttgaacctggaagacagaggttgcagtaagccgagactgtgtcactgcacactccagcctgggtgacagggagagactacatctcaaaaaacaaaaacaaaaaaaaaaaagagagagagaaggctgacctgggtggaggccacctagacctggggacacatctgtttgtgttccgtgtccaggcaggtgtgccatgaatgtgtcctgaatggaattaaatgtaatcgaatgggccagttatacatgcttgcggggaagtaggatggcaacacattctccttaaacgtggtcatttgatctgggtgtagattgcagaaggtctgacctcagcttaatgtgaatgatttgcaccccaggagagcagggggtaaccctcatttgcttattttctcatcccacattatcctcagtgcacaacacgaacacgctgcccgcccccactcccagttggcagctggggacacactcgtcagttgaagccatttgccagtatagacccagcaaaac

SEQ ID NO: 393003 - DNA, 569 bp, Homo sapiens
ggtagctgctctactacaggctgaaggacagggcctgaagccttttggactgtagaactgtaaaggtcccataaagactcagtataaatggcctgatatgtgagatgttaccagctagagttcagtggcataacctgttttagaaaacataagctaaaaccgaaatgaagaggcttgtcacaagtaattaggttttcatgttagtctttgtaaccacatctgcacactattagttgcccctgtccgtactttttaataaaggtaaacactgttaaaaaaaaaaaaaaaaaaaaaaaaaaaaaaaaaaaaaaaaaaaaaaaaaaaaaaaaaaaaaaaaaaaaaaaaaaacaaaaagaaaaaaaaaaaaaaacaacaaagaaaaaaaccagagaacagcccacaaaagagagacaaacaaaaaaccagaaaagagagaaaaagaagagaagaaaaaagagaaaacacacaccagagcagaaaaagcgacgaaacacgaaacacaggaatgaaaaaaacgaagagacgcaacaaagcggagcagaaagagggcaacaagacccaagcacaac

SEQ ID NO: 393004 - DNA, 293 bp, Homo sapiens
cctgcctgagcctcccgagtagctgggattacaggtgcatgaaaccacgcccggctaatttttgtattttgagtagagttggggtttcaccatgttagccaggctggtctcgaactcctgacctcgtgatccacccgccttggcctcccaaagtgctgggagccaggcatgagccaccgtgcctggccccttcttctactctttttcccagcttctcactactacacttaactagtcttaaaaaaaaaaaagaactatactcatagtacttggggagacctgagccagccagg

SEQ ID NO: 393005 - DNA, 282 bp, Homo sapiens
atgtaggtaaatctatatagcaaaacgatgatgacgtttcatggtggctaaaatatatatggaatttaaaaacacaagagtatagtggcaaataagttgagtaaggggtacagtatggaaggaaatgaataggattaaagtgtcttaggtttcttgcactgtctgcaaaaacaaaacaattaaattaacaaattatcaatctaatctaatttacttaatttattaacagtttgattaaattaggtcaagggtgcatgctgtgatctctaggacatgaggtct

SEQ ID NO: 393006 - DNA, 338 bp, Homo sapiens
acctgcctcctgataactaatgtgtctaatgccaccagagcgtctcccaggcccaggggctttcctgtttatggaagagcttattctgagagctgtagaagcctattggattccctgtcacgcacgagaacaatccatgcatgacataattctaacctgcccgctgcctcaccccacttttgggagcagatggaattgcatcagaagaatgagacacttcgagccctgaggtttcttcccccctgcaactctctggacctttgaagaaattaagatccagattttaagagtggctctcaggggtgtttgtggtagtgtccatggtgactaatttctca

SEQ ID NO: 393007 - DNA, 593 bp, Homo sapiens
ggttaaacatgctaagccctccattggtgagaaccgattcttatgaatcggccccgccccacaaacggcggggggcggtgaacgcagaagccacttgctctggaagccggagggcggagccggctcacagccgagagagaaagccgcagttgagcaccgccgggggattttcctccgccgtcttctcttcccccgcgcactcctcatgtcccgtagctcccagctccgcagctgttcgagactccgcactggatccgccgggtgtcggattcagcaacagtgattggtgcggaggatccgagggagacgggccgacacagggtctaccttgacatggctcgacccctctacagaagcagaggggcgctcgaagagtcgccagggaaaatggagccttaaggtttagtttgggtagtgaggaaagaggaaagagctgtcggaggctgtttcatttttcccgctttgcgacaaggtctagagagagttacaattttatttgaaacagtaaatagacacattaatgtgacctgatagcgtgcaccatcagtatatgataaaattaggagaaattaggaagtttagcaaaacgtgtg

SEQ ID NO: 393008 - DNA, 277 bp, Homo sapiens
ataataagtggttattaaggagaataaagggacctggaagacagaatttaacttgtaaatgattctctttggaatctgaatgatcctgagagtcaggaattatcttgtaagaaagtccaatgttccccatctcccctgttccctgtgaagggtaaataagcatctgtaccccattaagttgttgggtaatcacactgctatgaaccctcaccctctgcacattaaataaattttgtatgcctttttcttctattaatctgccttttgtcaggtcatt

SEQ ID NO: 393009 - DNA, 263 bp, Homo sapiens
gtttagctcggtaccctatttttttgcatacaaaaagtgtatatataatatgtatagtttaatgaataatgaaaacaaatcaaatgcttgtgcactaaccccctgggttgagaaatagggtattactggtaagtttgaaccctctatcttttttctattatattttctcctcctcccatagaaatgactacttctttgaattttgtcattctttttcttttcttcatagattggccagatattgttggatctctaaacagtat

SEQ ID NO: 393010 - DNA, 410 bp, Homo sapiens
gaggaaaactctccctactgtatcctatgagggctattaaccctaaaaagacactcaaatgtatggcaacatgtgtgtgtgtgtgtgtgtgtgtgtgtgtagaatctcttttctggtacgtattttccacattcctgttaggtttactttaggcattttgatagtcactgggatttctctccaccctcctcccatggactttttaaattggctattagcatatagaaatgcctgtttaaaaatatgaatcttatatgcagcctcttttatcaaattttttattcattctaatgctttctcattttatttttttttttacatttcttaggaatataatctatttgctgcaaatgacagttctcctttttatcccttgcatattgtgatttttcaggggaatacatgtgagg

SEQ ID NO: 393011 - DNA, 356 bp, Homo sapiens
tttgttttctcatgcagtgtttaagccttctcagatattcttaaatgtctcagggatactcatgagttgactttctcgagagttataagccccgctgggtggatattatatttgattttctggagccttgttgcccgttaacataacattcagttcttgaatgattaatctgtcgtttcccaaatacatacccgctgtattttaagcaaacagttgcgtgctgtaagcctgaagtgggtgtaacttctgcagtcaaccttgaggagggcttctcccagcccttggtgcacgtcaatcattcatgggaggtggaacagtagtgattttcagccatgtttctagcactgtttttaagc

SEQ ID NO: 393012 - DNA, 558 bp, Homo sapiens
tgagcctcagtgtttctcatctgcaaggtgagatagtaactctaacctctccaggtggttgagaacataaaacaaaatgaactctgcctataaagtcccttactaatggctggcatataacaggagtgcaatgagaagtagtccttattatctccccctctatactcgcccatacagcagagagctgggcaataggaccagcttgttcctgagtgcagaaataaccacagtggggtgttcatgcccaggttatgtatgggcttggtcatcttcatgaaaagatgtgtgcacagtaaagagagaacacatcactggggccaggaaggaacagtggtagaaggaaccccaagcttccccaaaactgcaaattccctgcctccaacctggggcacctctggcagccagccacgttggcagcctcgtactttctcttgggctcttcctgttggcatagcccaccctgttttacaaagctccagtggttttttttttttttttttttcaagggctccagctgttagataaattttcagggatattccgggggaggtacaaacc

SEQ ID NO: 393013 - DNA, 160 bp, Homo sapiens
tactaatgatgagagtgatgagtgtctcccgtggccgtgtcctctctgaatctctgagcattttatctttcatctctgtgggagttgcggcttagtaataataattagagtaccctgagcatcggtgctttgtagaacacagcattaagccctgtttctg

SEQ ID NO: 393014 - DNA, 413 bp, Homo sapiens
gacctagaactccccctctctcacgttggttctggtcacaaatgcagtctcaaaacctcttcagagtcatcttatggaaaactcaattcgctgaggaatccaaactaagcaagagacccaccattataaataagctgccttagtcctgaaggctttttaaatgtaatttctttctacagggcactttaaacatatctgatagatgccaatgagaaacactaatctagtcatctaagaactgtgtaaacagagagagtactactttatatacctgagataaagtaaaattaccagatttaagaacatttaccatgtgacaaggactcaatttttaaaaggtcctactgtaagatcaaacaactatgccataataatggaacatcaaaacactcctcatcgtgagagaggaacac

SEQ ID NO: 393015 - DNA, 500 bp, Homo sapiens
tattgtatttgcctactgctaccttaaaagctaacttcaaacttaagtcttaaaatatttcacagctttgaaattttaagtgacttacagccgaaggaggaaaaaagggttatctatcgtggaaggtatgtaggaaccactttatagatcgctaaagataatttagtccgatttaatctattacacttatcaggaaactagcacctctgcatccttctggggaacctaaaatgcttatatccagggcctggcactagtgatgtgaacctggattcagttctttttggagcgcttccatgttatatgttctgaccgtcatagtactgtctcccagtttgactgcttttgcttctgttgttttactccagacaaggaattcacagtagatggttctgagggatggttctatgagaattatttattaattgatctaataagtatgtattgagcactcctaccaaccaggcctggctctgagtgctagggatgtggtggggcac

SEQ ID NO: 393016 - DNA, 280 bp, Homo sapiens
atcacatagtaattataggcttagctatcacagtaaacaatttacatcttgttattcaaatatcttagaaaccagtcacatttttagctaaggaactatcactgagagtatcaaatctgtaatgtatacatatctttttgaattttaatatggataatttgactttaacttatactcacaatcatcactataaacattcatccatgcattgaacaattactcaaaacactgtcttttggaataaaaaacagacacagtctctgtcctcacagataatcaa

SEQ ID NO: 393017 - DNA, 315 bp, Homo sapiens
tgtctcaaaaataataataaatgttagcatctcactcagttctgtgtgatccagctcctgccaacccatctgatgagctcctggttcactctccttgcttcctgctttcacctcctgtggcccctgtcccgttcttcccatgtgccaagctcattccagcccccagacctgtccgctacttttctcctccagatcttaggttaggtaacactccagccccctctgagatcacctacacaccttctgttcacttctgtcatcctattgctaaattactttgtctcaaggttcgtaatctctgtgagggagtcctct

SEQ ID NO: 393018 - DNA, 427 bp, Homo sapiens
agtgagctgagatcatgcctctgcactccagcctggtgacagagtgagactctgtcttaaaaagaacgaataaaaagtccagttaaatgtgccttccctttgagtttccagagctttccacattctagtgaaacctaggagacctgagttaccacagtcaagtggtgaactaagtgtgtcctgatcagaacaaaatactgttcctcggtatctttccctttcttttttatttaccattgacagctggctacagagatcatataatctccagaaagaatgctggtatagcttctgtgaggacaggaggctcctgacgatcataaagtctttttcatggagtcaccattgaccctttggaagtgttcagtgccacttctttctcatatcaacgtaaaactctgcaaagtcatctccttctcatctgtta

SEQ ID NO: 393019 - DNA, 439 bp, Homo sapiens
atctcacagaagtaaattctattcataaaactacaaaatctctactctgcaaagggcactgaatagtaaattattttgttagacagtcacagattgaaagatacacacccatgtcaagattataatttaaactagtaggcagaaaaacagatccttctggttctcattctctttgaaagttctggggcaaattctccagattgtatctctcattcaaatacatgttccttgggtaaatttagataagactgaattcaaaagaaacaggcacctgctaaaaccctatcttccttaaggggtcagtcatgaactgagatctataatggttattgttgcttttattgctgtatgtttgcagaaccttttgcaattataaccagtagttattcaggtccttaaattctctgcagtttatgctgataaagggatctcattaagg

SEQ ID NO: 393020 - DNA, 296 bp, Homo sapiens
aattgttgggcaggttggggagggctagtcacggaacaaaactgtaagctggaccggttgtgagtgggggaggcgatagaaggattatagggtgggagagtggaagctgaggaagaactgggacctcgcttggcctggtgaggagcagtgtggggaggaggggagaggtcggatgagttcacagaaaaagaagatttaaaggactcagagcttggggtggagactgaaggaacagacaggagagaaagaagaaagatctggaatgagtcacattgggagcagagactagggaggaa

SEQ ID NO: 393021 - DNA, 360 bp, Homo sapiens
gtttcaccatgttggccaagctggtctccaactcctggcctcaagtgatctacccgcctcggcctcccaaagtgctgggattacagacgtgagccaccatgcccagcctccattctattctattcactgacctcctctcttggtccagtgctgggaaatgtcacctttcaggactttcacagagatgctagaaatctctgtcccttccctactcacagcccttccctggttccccactgcccttggtgaaaaagacaaaatcctcactgtagcccacaagggcttatgcatttggcctctgtccatctctcagcccttccctgctccctctctacccattgctctctgcaccgcagccaa

SEQ ID NO: 393022 - DNA, 427 bp, Homo sapiens
gcccctcctccctgtctttgtgtcctcttgtctgcttctaagggcaccaggtgctgacccccggcaggccctgatcccatatgtgaatcatgcactgatgacagctgctaccaccctgcttcagaaaagctcctctgtgaggccccgggtgcaggatgctgagtagcgcggggaacagcactgctggggaggaacgaaaattgcgaggtccctgagcgggggacctggcagaggccaaacgtcagaggtcgggggctgcagtaagggcctttgaagttagatttcatcaccatgtgcgggggggaggcactgggcatttcagcaagggagaggggccactggctggagaagggactatgggagagatggggcagggagcccggcgtggatggccgccgtctagacgggcatggggtctgtgggcgtg

SEQ ID NO: 393023 - DNA, 757 bp, Homo sapiens
tcatctcaattcttagaccttttatacctgtttttctcctttacttattccgtttagtttttcaattcatacaaaaccgtatccaggtcatcaccaataattctaaatgacgaatgtttcttctaacaaccgcacaatatcaccccttaccacaagacctcccttcagcttaatctctcccactctaggttcccacgccgccccgaatcccgctcgaagcagccctgagaaacatcgcccattctctctctccacaccgccccccaaaaattttcgctgccccaacacttcgacactattttgttttatttttcttattaatataagaaggcaggaatgtcaggcctctgagcccaagctaagccatcgcatcccctgtgacctgcacgcatatataagcccagatggcctgaagtaactgaagaatcacaaaagaagtgaatatgccctgccccaccttaactgatgacattccaccacaaaagaagtgtaaatggctggttcttgccttaagtgatgacattaccttgtgaaagtccttttcctggctcatcctggctcaaaaagcacccccactgagcaccttgccgcccccactcctgcccgccagagaacaaaccccctttgactgtaattttcctttacctacccaaatcctataaaacggccccacccccatctccctgcactgactctcttttcggactcagcccgcctgcacccaggtgaaataaacagctttattgctcacacaaag

SEQ ID NO: 393024 - DNA, 251 bp, Homo sapiens
ccacacacagtaggttctttaaatgtttctcagtttcattctacttcaagtcaagtaatcctggtagcattcatgactgtggaagacaaaataacccagttcctgtatccaagaagcagattctaattgaccagctgacacgttccagtatggagagcatctgacatagaatgaaaatgagcaatggcatagcactttacaagccataatcatgacctggtttgattcgcacaaggtgttaagaatcacat

SEQ ID NO: 393025 - DNA, 228 bp, Homo sapiens
tgaggcgggaggattgcttgagcccagaagcttgaggctacattgagccataatcgtaccactgcactccatcccgggaaacagggcaagaccttgtctctaaaaaaaaatgcttcttgcttgatgacttgtgatatatgaaaaggaagaaagaaaagaaaagctttgccctgtgtgcctggcccgaagtaagtgctccataaattggccgtggtgtagctgtggatt

SEQ ID NO: 393026 - DNA, 207 bp, Homo sapiens
ctcccaaagtgctgggattatagggatgagtcatgaccccggctgtgaatgtgcatttttaataaatatcccaggtgattctaatgcaggtgctctgtgggccacccttttgaaagttatgggaagaaattacctggaatgttttgctgggatgacttccttctccagctgcgtgatacagatgcccctgcttacgctcagctgcag

SEQ ID NO: 393027 - DNA, 560 bp, Homo sapiens
aacgaggaaacagttatactgagcgtcgtattacacatcaggatccgagcctataaaccgtgggcagttcagataactcctcccctgtgctatttggctttttagggagtagcatcatattgaggtcagaggggactatttagtgcagaaatcccgtctggatgaaaaaccaactaggagcacaagatgagtgagtccggggtgttctctcaaattcacctggagatggtattggactgtgagtcagcagcatggtgctgccatgaagaaaagacagctagaaaggaaagcgcaagtcggggtggagccaccaatccgcttgagctaactgcacactggcagaggccttttctgggctgttcaatgtgggggaagatagataactgtgcaccagctttaagcattgtccttgttctatggagcttatagtctatgctaattaagtagaaataagaattaaggactgggtgcggaggctcatgcttgtaatcctagcactttggaaagctgacgtgcgtagattgcttgagcttaggagttggagaccagcctaggaaacc

SEQ ID NO: 393028 - DNA, 234 bp, Homo sapiens
tgctaggattacagatgtgagacaccgtgcccagcctcatatattttttgatgaaagtctgctgaggatgaattctgtccacttttattatctgaaaacatctttattttgcctcattttaaatagtatttagattgggtgtagacttctatattgccaattagtttcttttagcactgtaaatacagatgtccagtattttcagattcagttatttcagctgaaaagctagct

SEQ ID NO: 393029 - DNA, 519 bp, Homo sapiens
tgttctagaggatccctctaaacgtatcagaacccgttctgcttgaccttgtctgagttgggtgtatgtctaaagcaatcacaggagacccagtcctgcagtttaatggcacagagtgaccagcgattgtccctgctgctccccagcaaggctttctcacaaggcctgtttctctccccagtgtgtggttgtgagctcattccccaccctgcaggcccccccaactccagtggggaaggccatagtccctccatggggctcccctcacaggaggttgtgcctgaggattcctaaaaaaatgctctctgtggttacatggtggaatttttccgtctctctcatctgcctcaagtaacctgaatgattgtgttttgacaagggtgaaggttcgtctggagctaggtcccagttcagggttcactcatatccacagcagatgctctctgaggttccatcccaccctgagccttgtactagtgttacacgtggtctgaggttggaaaaataactatttttgga

SEQ ID NO: 393030 - DNA, 275 bp, Homo sapiens
aaaaatgtaaagtgagaaatgcccattaaaataatgtataacataaccacatttatttaagaatgtactcgaatatcaaatgacaaattccaacagtgtaaaaactgtgattccttttgcaccaacctcatactagccaggcatctttctactgaaactggctggagaccatgtctcagtggtggagccggtataggaggcttcacatttcttcccctaggacacgctgtcattgtttaggtttcttgttttgttttttcctgaaacagggtctc

SEQ ID NO: 393031 - DNA, 105 bp, Homo sapiens
actatttgagagcttactatctaggcattgtgatatatactaggggtatacagccaagagcaaaacacagtatctgccttctaggaacatgtagttacagagctg

SEQ ID NO: 393032 - DNA, 291 bp, Homo sapiens
aaacattaactattgttattatcaccattttccaaaagtgtgcaaaggggtgtatggttagtccctgtctagctactaagtggaggaattgggttttctgactccagagcaaaccgtttttctccactccgtactgcctgccgatggctgctttggagtttgtctggctctgggttgtgccttgaacgcacaacttacctaatagagcctggggctcttttctccattaaagacaagctcactgtgagctgggcaccatgtgttgccagagcctcatgctatatgtcaggc

SEQ ID NO: 393033 - DNA, 360 bp, Homo sapiens
  misc_feature (15)..(15): n is a, c, g, or t
  misc_feature (32)..(32): n is a, c, g, or t
ggggaaagcaacccncacaccctttactcctngagatggaaagagtgaacattaatgggaattgcaaagagagaaggaaactgaaaacgagttaggttgatagactaaaatatgagaagtttataaaatcatgaatggattagacaagaggaacatggatttactatttaaattctggattatagccctttaaaaatccctgaagagggcaacatggcaaggctctgtctctacaaaaaattttaaaagttaaccaggcatggtgttggacatgtgttatcccacttacttgggaggctgaggcaggaggattgcttgaacctgggaggtcgaggctgcagtgagtcgtgtttgcaccac

SEQ ID NO: 393034 - DNA, 1715 bp, Homo sapiens
gaatgcattttgatgaagttgtgacttcatagcaacctgaaagacaaaaaagcagttaccagctaagaggggtgaaagagctttccaggccaaggacggggttagtgtaaagtcttagtagatggagacaagggatgctggaggaactagaaggctgggggagtgctgggcagagacgatggctggaggggccagcagacacagtgtctcacaagccttttaggccttatgaaggattttggtcattagtctcttaggagcaattggtagccctcatatggttttaagaggaggggatagacattcaataagtaatttttagaagaataaatgagtctgttaatcacttatctcccaaatcacttatcaaattaagtagttagtcacttatcaagagcttgaatgtacgggacacagcaaaggatgttttggtagaaaaaagggatgggaaaaatccggaaggtgaggtgctgtcttagagttgaggcccagacactgtgtcacagtggggtccctgggccctgcgggaagatctgagtactgcgcacctggcatgggtgtgtggttcaagacagatatgctgaggaagaaaggggaggatattccagtgtctttaacatcaaagacgctttgcttacttcatgacttgagatcagggttaaccattcttgaatatgttgcaggtggaaaaagaggaaaacctagtgattatttgaggcctttactgagccagtcacatctcctaaaccagttagaggagttcattatctgacatggtaaaatgcagatgtccaaactgaaatgcaattcaacccttataaagacattttctgatcctgacatttactgaccctgactttctatgtctgtaaattgggaataatgatacctatctcactgggttaaatgagaacatgtacatactgtgctcagcatagtgtctgggatctgtggcagcagctattttcatggcaattattctgtatgtatgacataactttaaaacttctctagggaccaacaaggcaatgcaatcaaacaccagcacagccaataaggggcaatacggagtggtggggactgtggcaaactggagaatccttacctgtccaaagagggcaacagctcctctttagtttcagctattagctactgagcaagaactcaaaacaagtgctttctgacttttccagaaatgctggaaatcctaatgcataattttgttatccaattcaaataaaaaactgcaaacaataacaaccaccagaattagcaacactatggaacacaaaaaacaggttctggagcaaagctaggctgaaagcagctaaaacaaagttttacaaagaccaagctgttctgggaagtcagatctgcctcacagaaaagactctaaaagcatgtgaaaggtcataataaaatcaggtgcaggccaagcgcagtggctcatgcctgtaatcccagcactttgggaggccgaggcgggcagattacccgaggttgggagttcgagaccagcctaaacaacatggagaaaccctgtctctagtgaaaatacaaaattagctgggcacggtggcacatgcctataatctcagctactcaggaggctgaggcaggagaatcggttgaacccaggaggcagaggttgtggtgagccgagatcgtaccattgcactccagcctgggcaacaagagcaaaactccgtctcaca

SEQ ID NO: 393035 - DNA, 198 bp, Homo sapiens
ttgattcaaggccttcttcttttttcccaacaatttttcatagttgttgaacaacagactctaattctcaaatgtaaggttgataactgatgattagctaatgttctcaacaaagggataaaattcaagctgagttttcagccaggcaggtggctcacacctgtaatctcagcactttgggaggctgaggtgggcgga

SEQ ID NO: 393036 - DNA, 844 bp, Homo sapiens
tgcgccggctcttcgcgggcaccgagaacctgccggtggccgccttccgcgcctcgtgggggggtcggggccacggacggtccccggcgccgcaattgacgccagaggtgaggcatcaagaataaagattctggagcaaaactcagaattacctcaacgtgtatgcggctggaatggcctgcgcaccttgtgcatcgccaagagagttctgagtaaagaagagtatgcctgctggttgcaaagccacctagaagccgaatcctccctggaaaacagcgaggagctcctcttcctagtctgccgattcgcctggagaccaagctgtcacttgttaggtgccactgggattgaagaccgcctgcaggacggagtccctgaaactatttctaaattgctgtcaagcgggcctgcagatttgggtactcactggtgacaaacaagaaacagctgtcaacattgcatatgcctgcaaactgctggaccacgacgaggaggtcatcaccctgaatgccagcctcccaggaggcgtgtgcagccctgctagaccagtgcctatgctacgtgcagtccagaggcctccagagagcccctgagaagaccaagggcaaagtgagcatgaggttctcctctctctgacctaccctccacgtccactgcctctggccgcagacccagactcgtgatcgatgggagaagcctggcctacgctctcgaagaaaaacctgggaggacaatttcctcttccttgccaagcagggccgatccgtccttctgctgtcggaccaaagctctgagaagagcatgggggtgaaagctggtgcgaacaaagaccaggcctgaaccc

SEQ ID NO: 393037 - DNA, 691 bp, Homo sapiens
atccatactggagagaagccttatgaatgtagagaatgtgagaaagctttctgctgtagctcacaccttactccacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaatgtgatttctatctaatgaatgccatatatgtgggaaagcctttagtcataggtcatccctgcttcaacatcacagaattcatactggagagaaaccttacgaatgtattaaatgtgggaagaccttcagctgtagttcaaaccttaccgtacatcagagaattcatactggagaaaagccatataaatgtagtgagtgtgggaaagcttttagcaaaggctcaaatcttactgcccatcaaagagtacataatggagagaaacccaatagtgtggtaagtgtggaaaagcctttagactatatgaatcactatacatgtgagaaatcttacagaagagaatgtatatgaagcagtgtttatcatggtaaagttcattcatagatcctcatttaacatcagaaaaaattatactggggaaa

SEQ ID NO: 393038 - DNA, 249 bp, Homo sapiens
gctcttctgaatttttctactgctttctgaaagcagcctagccacaatttctctgtcatgaatttctttaatcacaacaaatttctactacttgaattatccattaagagtattatatatcacaacccccatcttgtaaccagtgaacttaatacatgtcttcagtgtaaatttatcacattttttttgcaattatgtatttgtttctatcatactttaaatgaaaaactttatgaagtcaggcacaat

SEQ ID NO: 393039 - DNA, 1353 bp, Homo sapiens
ctctgcctggttcggcccgcctgcctccactcctgcctccaccatgtccattaggggacccagaagtcctacaaggtgtccacctctggcccccgggccttcagcagccactcctacacaagtgggcccggtgcccacatcagctcctcaagcttctcccaagtgggcagcagctgctttcggggtggcctgggcggcggctgtggtggggccagcggcatgggaggcatcaccgcggtcacagtcaaccagagcctgctgagcccccttgtcctggaggtggaccccgacatccaggctgtgtgcacccaggagaaggagcagatcaagaccctcaacaacaagtttgcctccttcatagacaaggtacggttcctggagcagcagaacaagatgctggagaccaagtggagcctcctgcagcagcagaagacggccgggagcaacatggacaacatgttcaagagctacatcaacaaccttaggcggcagctggagactctgggctaggagaaactgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgactgatgagatcaacttcctcaggcagctgtatgaagaggagatccgggagctgcagtcctggatctcagacacatctgtggtgctgtccatggacaacagccgctccctggacatgaacagcgtcatcgctgaggtcaaggcacagtacgaggagatcgccaaccgcagccaggccgaggctgagagcatgtaccagatcaaggatgaggagctgcagagtctggctgggaagcatggggataacctgcggtgcacaaagactaagatctccgagatgaaccggaacatcagccggctccaggctgagaatgagggcctcaaaggccagagggctttcctggaggccgccattgcagatgccgagcagtgtggagagctggccattaaggatgctaacgccaagttgtcgagctggaggccgccctgcagcgggccaagcaggacatggcgtggcagctgcgtgagtaccaggagctgatgaacgtcaggctggccctggacatcgagatcgccacctacaagaagctgctggagggcgaggagagccggctggagtctgggatgcagaacatgagtattcatacgaagaccaccagcggctatgcaagtggtctgagctcggcctgtgggggcctcacaagccccggcctcagctacg

SEQ ID NO: 393040 - DNA, 577 bp, Homo sapiens
ggagagttgcccacattaaagaacatcctccatgggtctcctgcatctagtgggctaacccatggtcaggcctcaatcctccctagttaatgggtcattttataagtcattcttgtagagccgtacttctttttttttttttttgatggagtcttgctctgtcacccaggctggaagtgcagtggcaaagtctcgacccactgcagcctctgcctcccaggttcaagcaattctcctgcttcagcctcccaagtagctgagattacaggtgtcagccaccacacctggctaatttttgtgtttttaatagagacggggtttcaccatgttcgccagactggtgttgaattcctgaccttaggtgatccgcccacctcagcctcccaaagtgctgggatttcaggcatgagtcactgcacccggcagagctgcacttctaagggaagttaaatctgatttcttctcttctgagctaaaaaggttgaaaggaagagaaacctgccccatctcccttttttttgtctcgggtttgaaggtaataatcatcataccacttgactggtttaccaaaaaaaaa

SEQ ID NO: 393041 - DNA, 332 bp, Homo sapiens
tatcaaaaatagtaaatggagcccagtaggtttttatgaatgtttcactgagaatggtttgaggtcctggaaaatagtatatagtaatttctcactgatttcaactctggtatttgtgatggtttggggatggggagtgagtataattgctattcagttggcagtacttaacatttcctaacagtatagaaaaaattttaaatgctttttaagtttcctgcccagaaaaggagtgctttctcaatcttgatgttagcagagcccactatctccctcccatgcctgattgaagcatcacgcatctccttggccctttgaaagcttatgtggtg

SEQ ID NO: 393042 - DNA, 383 bp, Homo sapiens
aaaaaaaccataataatcctaagctttaatcttacaacctttttcttaatattttgagaatatctcttgtgcttttcaaaattacctgaagttcagcagtatttctgttttagtttagatttattttcctgttatcttcaagcaaaagatctatctcactatggttaagaaaaagattaaagagattagaggtcttaaaaaaaaaactatacatgttaactttaagaccttcccctttctgttcttaccttccaatttttattggctttaagtgtgtgtgttttaaggttataagactggtgacttagtcaattacaattgtactggttgtataggaatttggggcagtgtgaaattgttttgctggggctgaggaaaaaatt

SEQ ID NO: 393043 - DNA, 650 bp, Homo sapiens
taggaaaagaggttggaggaagatatggggaggtaggaaaatgggacttttttcctccatttacttttgatgtttgaatttcaaacatgagtatatttgtgtattattttgcggttaaaaacactgaagattgcataaagatcaaagagggaaatttaagggaattaatgggttatgattgcatttgttcagaatggttttggtggctcatgacaacattttgagagagagagattttaatggcaccaatggcagctaggataactagtttaaagtttagggcctgtgttaatagattttgctttctagtttcagaaagattctcttatagtactgttttaatctgtttttctaagccctctgatttatgtatatttaataggccacaaaataatgtcaaatatatggcataataaccaacaaatatttgaataagtgaaaggtactctacaaaatgctatgggaaagacaaaaataaataatatccctttctttgagggattaacagtgttaatatcccttgttttcatttgatttgaaatgccacttgcaagtggaatatgcagactaaatggtaaagagaaaaacaagcagcatcttttcatttcacttacagctcactgtatgaccaataatatgttacttgacct

SEQ ID NO: 393044 - DNA, 405 bp, Homo sapiens
cagggggcaggacgaagtagggaagaaaagagctcaaaattccaaaggcaaggcacaaaataagtttcctgattctaactcagagaactattacagaaagaaaatagaaaaatccaactgccctgcagggaaaagattcatctggcatggggcattacctaacacacagaagtcagttttccaggcctgcctggcatctgccctagaacagtgcctgatttggggtaactcccaccaccccagtctcagtccatgtgactcataagaggctgggaccccaacccaaagctctagagccctacattcctctggccagtgatgggctcagaggcaggaacatgacccagcagagatggagaggccgagaggatgaccatgggcacgagactgggtggccctaagcct

SEQ ID NO: 393045 - DNA, 669 bp, Homo sapiens
gtttcacaacagccacacattaacattacttagctctattattaatagtatctgtcatgtactaagcagtttaaaaaatacattttgaatggtctaaaagtttaaaataatatgaccacattttagtttaaaaacatttacacaaaaattctcagtaaatggagttaaaatatgaaatttgaatgaaaatacagatatgtgccttttattcacatttttaacagtctgtataaatagtttaaacaagaattcttaaatttatgaagcccttggatatatatgcatatgtatttagctatctaaaactattgggttcctgagtttggaatgagagattggttattgttctgatagcaggggtggtttgtgagccatgccctgagttttggctagtaagagtctggatagcaagtgatacatgtgagtctggatagattccaatgcagtttttggaatctattcggttcctgagttttggaaaacgagaattcaaatagagttcaggtggcaaaggatccttgtgttatctctttgtatttctgtggttatatcagttgacatttgctttagcgtattatttgctgttgtttactatatcagaaaagagtctgtagtaataaactttcttttactttgagcaaggaaatactttttaaattaagtgtatgt

SEQ ID NO: 393046 - DNA, 286 bp, Homo sapiens
aaaaaaataaaataaacggcaagattggttaagaaggcagacttgagaagcagaattcagctcagccacttaatagctaagtgaacaaacactgtaaagttatttagcctctttatatctcagttttctcatctaatgattaaaacagcacactgctcttgaggttgttagaaagaaggcagtatgtaaagcgcttagaacagtgcctagcccacaaatgtgaggtgctaattttatgtggattatcttatttcattcttacagcagaactaagatgcagccatga

SEQ ID NO: 393047 - DNA, 697 bp, Homo sapiens
tgtaattccagctactcaggatgctgaggcaggagaattgcttgaacctgggaggtggagggtgcagtgagccgagatcacgccactgcactccagcctgagcgacagagtgagactctgtctcaacaacaacaacaacaacaacaacaaaattagctggacatggtgatgtacctgtagtcccggctaccagggaggctgaggtgggagaattacttaagcctgggaggtcaaggctgcagtgagctgtgattgtgccactgtacccagccttggcgacagagaccctgtctctaaaaaaaatgaaaattcagtttaatttctagtatcatctgaaggctgtttccaggttctctgagcctggattctacaggcttcgtggtttgagttgggaccccctaagtcaggaattgggctcacattcttggaaggtgatgtgaggggcagttatcactggggtccctcagccaggaaggtttaaggagaagacatggatacactcggagcaacttgggctttccattgccccaactgctttttcctgctgaggtggaggtgctttgctccctcccgctcagcagatttaagctgaaatctgaaagatcctatttagcctgtaccactgggattcatggagcttcatgaagcatatgataagaaaagacatgcatatttatgattcagagaggaaaaaaaa

SEQ ID NO: 393048 - DNA, 960 bp, Homo sapiens
cggggtggccgggtggcggcggcggcgctccggtcgcgatgggccagaggtgacgccgcagccgccgggagccgcgagggacggggcaggatgaaccgggccaagcccaccacggtgcgccggcccagcgccgcggccaaaccctcagggcaccctcccccaggagacttcattgctctgggctcaaagggtcaggccaatgaatcgaaaacggcgtccaccctgctgaagccagccccttccggcctgccttctgagcgcaagcgggatgcggcggccgcgttgtccagtgcctcggccctcaccggtctcaccaaacgccccaaactctcctccacaccccctctgagtgccctggggcgcctggctgaggctgcagtggcagaaaaacgagccatttctccgtcgattaaagagccatctgtggtgccaattgaagtgctgcccacggtgctgctggatgagatcgaggcggccgagctggagggcaacgatgacaggatcgagggcgtgctgtgcggggccgtgaagcagctgaaggtcacccgcgccaagcctgacagcaccctctacctgagcctcatgtacctggccaagatcaagcccaacatcttcgccactgagggcgtcattgaggctctgtgtagcctcctgcggcgggacgcctccatcaacttcaaggccaaggggaacagcctggtgtctgtgctggcctgtaacctcctcatggccgcctacgaggaggacgagaactggcccgagatctttgtcaaggtgtacatcgaggactccctgggggagcggatctgggtggacagccctcactgtaagacgtttgtggacaacatccagacggccttcaacaccagaatgccccccaggagcgtgctgctgcagggggaggcgggccgcgttgcgggcgacctgggtgcagggagcagcccacacccctccctcacg

SEQ ID NO: 393049 - DNA, 170 bp, Homo sapiens
cataatttctttttttaaagaatcaaacacattaaaaacccaggagaatcatttctggatttcttctaaattgtgttcactctgacattttccagaatcaaccaccattctttgttattgacctgtccataaacatctctagggtgttatttttcttttgtgacatcatg

SEQ ID NO: 393050 - DNA, 357 bp, Homo sapiens
tgtttataagagtagacaaattccttatagaaggtcatgaaaattgatcatgttggagataatattctgaatcctgctaaatacactactaaattatctcagtaggaatcttgtaattttccactctttgaagtccatggcttctgatgctgattcattcctaattaaatggctttagctattcaaatcctagtatctccctctcaatatcctccctgtcatcatcccagaccttttttaaaaagttttattttaatttatttttttttttgagacagagtctcactctgtcacccaggctggagttccgtggcacgaactcggctcattgcaacttctgcctcctgggttcaagtg

SEQ ID NO: 393051 - DNA, 406 bp, Homo sapiens
taggctcatgacataatgtgtgcccagaagtcaagatctgcatttgtcaagctgcagacccagaaaagccaatggtataattctagtcctagtctgaaggcctgagaaccagaagagctgatgatataaattccagtctgagtatcagtctgaaggcagaagaccgatgtcccagctcaaatacagtcaggcagagagaaagaattctttctcagccttttgttctattcaggcctttagtcaagtggataaggccacactggggagggtagtctgcttttctcagtctaccaactcaaatgttaatctcctccagagataccctgacagacatacccagaaatagtgtgtaaccagttatatgggcaccccaaaattaaccatcacaatgggcacacattatgga

SEQ ID NO: 393052 - DNA, 266 bp, Homo sapiens
ctaaaggtagcttaacaaaggaatgaaacagttttctaacttgtgtttactgttaatcgcaagaaaagtattgtaaatgctgagctaaaaagcatccatttaattgacatacttttgcaaataaaaaccagtgaaactaaaaaaaattaatgctaatttatcatttcatgtatctatgttctttgcttttatttatcagtatcgtttacttacagcttttaaagttcagtaattagccctgtggtttttgacaagaaaacttaaga

SEQ ID NO: 393053 - DNA, 275 bp, Homo sapiens
ccacccccagcctattcctcttctcaatattctgctggagagtgcaggaacagtgaactctatgcaatgaacaaatgcggtgttccaaggccaggcacaacggttcatgcctgcactttgggaggccgaggcgggtgaatagcctgaggtcaggagttcgagactagcctggccaatgtgccaaaaccccatctctacaaaaaatacaaaaattaaccaggcgtggtgggggacgcctgtggtcccagctacccaggagcctgaggtgggaggag

SEQ ID NO: 393054 - DNA, 127 bp, Homo sapiens
caaaacaaaccagttattgaaaacaagcataagccattccaaagctactggtcacagaaacctgaattatcaaccgggtggtagaggagccaacaagaaacagaaagatgaaatggagtaagtgcac

SEQ ID NO: 393055 - DNA, 130 bp, Homo sapiens
ccctcaccatcagcctctcagtcagacacagcacccctcacggccattccatcattccattctgcatgtgcaaatgccgtcgcccagcacacacatccctccgagtcagctggcagggccaccctgccag

SEQ ID NO: 393056 - DNA, 118 bp, Homo sapiens
tggccatggcaggatataacaatgaaccagacaaggtttgtggactgaatgaatggtgagagaacgcatccaacgcacatcagaccaggcctgtggaatagacaaagtgctggcaaag

SEQ ID NO: 393057 - DNA, 542 bp, Homo sapiens
aagggcaataaccagtcgaaaaattaccagagcactcaagaaaacaaggcagagagagaaccaacaggaaaaaaaaaatgtgttttttaaatgcagcagaaatatattggcattgccacttggcgtagttttcaagcacagatataaagtaaatatgcttactgtatttaacaaaataaacatgaacaataattgcagagaacagtaaactataaaaagtgacatagcagatttaaggagtaccaaatgggacttttagaaaagaaaaatgataaccaaaattaaaatctccgtgaacattttggcagcacattgcactcaacagaagagaattaggaaattaaaagataaactagaagaaattacttcagtgctacacagagagagacacagtggtggaaactgcagtagcaaagaggagaagggtgcggaagacaacaaatgtaggtttgatggaagctctaaagagagaggagaggttggctgagaattttccagatttgatgaaagacaccagtcccaaacaggaatagtaaaaagaa

SEQ ID NO: 393058 - DNA, 1331 bp, Homo sapiens
agtgtttacaggcatgaatgctggtggaaagagcagagtaagggcagattgcacaagaaccgtggaggccctggttcccatcacctccacctcagcacagacttcagagaggagaggaggcactggatgcatgacagcagcacttgagataggtgctccaggtggaaggcactgcacatgcaaaggctgagtaggtagttctctgtgtgaaaatggtgatgtttggggtggatagctagtgaaaaagactggattgagcccaagtgaggaggatctgtgttgtgaggtatggagctttgactaaaaacatacattctaaaactaggtgggcttcagatttccattctgaggctctgccacctactggctatttaatcttggacaagttggttagcctctctttgcctgtattatcttgtgtaaaatgagagtaattataagattaaatgtgagcacttaagagtatattagtctgtttcatactgctgtaaagatactacccatgactgggtaatttataatggaaagaggtttaattcactcacagttctgcatggctggggaggccttgggaaacttacagtcatggtggaaggggaatcaggcacgttttacatggcggcaggagagagaggaggaggaaggaggaactcctaaacagatcttgtgagaactcactcaccgtcaccagaacaacatgggggaagctgcccccatggtccagtcacctcccttccttgacacatggggatcacaggtccctcccttgacatgtgttaattacaatttgagatgagatttgggtggtaacacagagccagatcttatcatacagccagtgtgtagttcagtaaatgctagctgtaattatcattattattagctccagttgtacaagagttccaagagtctgtgttcacaccaagcattgtctggggactaaacacaacctgcgtatatgtggctttttgatgttcatagctcctaatttcccattacgttttagagattagtaagatataaatttattttaaagtttattgaatttgcaggaactattttttattgggataaaatacacataatctaaattttacccttttagccatttttaaatgtataattcagtggcatttggtacattaacagggtcctgcaaccatcaccactgtttagctgcaaaacgttttcatcaccccaagaggacaccctgtactcatgaacagtcgttccctgattctccttccccctaacctctggcaactgctaacctgttttctgtcttttgggatttgcctattctggatatttcatataaatagaatcacgca

SEQ ID NO: 393059 - DNA, 282 bp, Homo sapiens
ggtttcagcttctcactgttataaaatatgttccagttcccatctgtgtaaatatatctgtgaacaaattcagcagcaagtaataataagctaagaatgatcttctgtcttcatcacgtaaggaacaatttggagcacattttgtgcaagggcatccaaagagtgaacacacaaaaaattagggaggaaacacaggaggtagaagggatagggggagagaggatgggctctcatgtactgtagtgcagtaagaccagggatgcccaacaggggggtaccgag

SEQ ID NO: 393060 - DNA, 497 bp, Homo sapiens
tagaagatggtaaatgatatgagaggggtatagagcttagagcatggagaagtgacctctgacagggtaaatgaaggatagcctccaggaggaagtagcatttgagctgggctttgagtgacctggacatgtgaggctgtccagctttccttccagctggagtaaagggagcaatcaaaggcaaggacctgagatcaaaaactcggctacctgtggctgggctcagtggcacaagcctgtaatcccagcaatttgggaggccgaggcaggcggatctcctgaggcccagagtttgagaccagcctgaccgatacagtgaaaccccatctgtactaaaaccacaaaaattagccagcctgtagtagtgcccacctgtggtcccagctactcaggaggctgaggctggagaatcgcttaaatctgggaggtggaggtggcagtgagccaagatcacgctactgcactctagcctgggacacagagggagaccctgtctc

SEQ ID NO: 393061 - DNA, 278 bp, Homo sapiens
gcaggatgcccactcatcatgttatcaacatgccttgaacctccaaggtgtgaggccaagacgtgccctggacactcaggatgctgaatgggggaaggcactggaggctaggccggctggagcgttgaggtcacaaccaggacgccctgggtgagctgccggtcacagacactactatcacactatcccgtacccacccctcactggcttcgccaatcctgattctgtttggtttaagttgtttcccactaccctatgctacaccaaccagaaaccag

SEQ ID NO: 393062 - DNA, 510 bp, Homo sapiens
tctctggtcttgcaggccctgcgtcaggcgatttcactgctgagctgaccggtccataaacaggccatgggcagtgtcacacgttttctcacacaacatgactgtggtttctcttaatttgtctcttctctgggcttcttcccgaggcctcaactgtgcggcagctgaaaaccatcttcacgctcatccggggtgagaattaaacagtcctgttagtaaagctctgtccttcagctcctctgtctttagccgccctccctgcggcatggttttaggaggagtgggagccactcagcctctgactggaagggaagagttggcccccggcacagggtctccagcatggagccttcagcctgccctgtggctgcccaccctttggccttcatgactcaagttggggccgctggtctctcttggctgggtcagggcccagggcggctccttggctggccagctcttgttggctgtgggtttctccttccctgcccaggaggtctgcccccgctc

SEQ ID NO: 393063 - DNA, 398 bp, Homo sapiens
gagaatccgtacaaagactgggaaccgaacccagaaagccttccatccttggtttgcctgcctttgactatttgtaccgtaacccccacactcccatgatatcaggcccagtcagtgcctgacctaggtacaatctcaatttgcacatcctatatattttttctagattccccaaccagaaaaagctgagatttaaattctataggttatggagaactaagtgtgacccaaatgagaaaagaaagctggctaaacaaaacacaattatgcgcataaaatgtctccaattttcctattcagcaaaagtcttgtaaagtaaaatggcatattacaacaatattagctcttggatgtaaggagcagaatgcactttagcatgggaaagataagagtctatc

SEQ ID NO: 393064 - DNA, 197 bp, Homo sapiens
tcccttcctgtatccctatatcctaacgtccttttctcttcttttctcttcaaaatttctcttcttcctatttccgtcccttaacactttgtaaatcttgtccttttatgaaccatatcacctgaacctcttttaggttttttttttttttttttttttgttttttttttttttttttttttttttttttttttttt

SEQ ID NO: 393065 - DNA, 523 bp, Homo sapiens
ttcttaccatctgagtaaaatgcaactccattattctagttcctcaagccaaaaatcttggcagcttttccagcaactccctgaggctctggcctctaacaagccagtatctgggaacccatgtagcaaataaagaataaacctccttgagcctaaacagaagggacagcactctatgtgccttcttcccctggcttacttcaggcgctaatcccagccatccactgtctccttggaaaaaggttggaggcctctgccagcaagaacaggaggaacagcaccctctgcgctttcttccctggcttgctcctgagataagtttctgcaacctctcattagaaggaggcaaggggacctctccatgacaagaaagagaaggggatagtccctgtgtcttcttccctggcttgcttcagggaactccagaccaaaaggttacccctgcaaggtgcatgtgagacttcttgcttgaacgggagagtaagcacactctgcacctccttccctggcttgctccagacac

SEQ ID NO: 393066 - DNA, 600 bp, Homo sapiens
ctagagttctcccaacctgtctctcgccatcccctccctggccaggtcatggcaacctgctgatcactcagtgcacttcctagtgccaaccccagtgagaaacaaactccccagatttctgtctcccacctttttaagaaacacgaaggaaaaggaggagccaggcccaggtgcaggctggtgaacgggattagagcgattgatatctgccaagctggtgctaatcttccttcccacctcttcccctccaaaatcaacaaacaactttcctctctctgccttgttctctgacctttgttccctccacacaggtctcagagctcagcatcctagaacagtttgagcaagatgtcagtcctgggggtgccaacctcacccacctccacttgtccaaagttggtgacccagaggacaggtgcaaccctaaatggtccaaccaccacagcctgtcctgtggccatctggggcccctctcagggtctggctgaggctcatctcagacccacataggaccaatatcagcacctgcctcatgctcatgtcacagcccactgggaccaacctcagaccctatatggtgccacccttacgccctcctga

SEQ ID NO: 393067 - DNA, 708 bp, Homo sapiens
ggaagaggattgagagcaggatccacgtttagggttttgtgccattgaaggtcagaggcagagagagtcgagtgtggtggcagtgtggaaatagcagctcagaaatctacctggagacatgaggaatgcagtagtgattaacaatggagctgagtcccaggtttcttaggatgtgacattggaccacctggatcacaagtttgtaggggcaaagtccaagacatctgaattgtattaggcactcagcgggtctttcctgtatactgaggtttcaggacctctcgcctactgaaatgtgagtggaaaagtgaatacaaggcatgcagttggcagaaggcacaggaatttgggaggagaagtgattgaaaatggcacatactctatactctgcatagtaagtaaattttaaaatatattcgattatgtatttataatatgttatttttaacttataattctgtgggcaatatattctattccaaagatagaataaggtgttatgaagcgtagtggacataaagtcagaggtcctggattacagtcctagtatgccatttattggctttgtggggttggcaaaccacttggcaaatctcagagactgttgtaaggacaagcgaactcatatgcacgggtagactgccaaaaatatgcacacaaaataatgatgattattttctttgtactgttaacatttctaactagtaa

SEQ ID NO: 393068 - DNA, 486 bp, Homo sapiens
cacacagactcacacagacacacatagactcacacattcccccacacacagttctcacacacatgcacacagacacacacacatgcattcccccacactcacacctgcacacccggtttccctagaaggctgctgaggctccctgctcaggcaggcaaggcctccggaccctctccctgccagcctggaagctgctcgcatcctcctgtttccagcccagagtcacgcacctctgtcaccctgccagaccttctaaatcctcaggaagtgggtcaggcctcatccagttcacacccccaacccccacatttcataaatggggagatcaaggcctggagaggcttggggacctatccgaggtcacacagggttgggcttacaacccagggctggagtgagagcaggcccagcgtgtactcatcccagccggcctggctgggcccctctgggactgacccaggactgggcatgagagggcctaggact

SEQ ID NO: 393069 - DNA, 229 bp, Homo sapiens
tatgacaacctatgaactgtctttgcctttcctcactaaagtggggaggcaaaaccccaatggcgaggcagcaggggaagagcactcaacttagaagaaccgggttataggccgggcgcggtggctcacgcctgtaatcccagcactttgggagtctgaagcgggcagatcacttgaggtcaggagttcgaaaccagcctggccaacatggtgaaaccccgtctctact

SEQ ID NO: 393070 - DNA, 142 bp, Homo sapiens
cagtcaaaaataatgcccaatttaaccttctgagcttatatgatgaaaacaacattttcaaaagtttcctcaacagatgattacactattaataatagtctcgctctgtcgcccaggctggagtgcagtggcgagatctcag

SEQ ID NO: 393071 - DNA, 256 bp, Homo sapiens
caacattgcccacacttatttgaccagggatctctatccatagagcctgtggtaagaagaatgcttagattccacttcagtaaatctcgatgttactcttaagtccattgtatgtaacttattttactaatttaataataactaaactttattaggtgatatgggtgacatttaaaaagactcttgatttaaaattaccacatgacaatccctaatttgtttaactgtatcatagctgaatttgtatatgttctgg

SEQ ID NO: 393072 - DNA, 330 bp, Homo sapiens
acaccctacactgatctccccagttagctcggcacccccagccccactctgccacctcaaactctgactcttctcaaccccagcttctgtctctctccctctgaaacctaccaagtcactttcctttctccatccactcccagattcctcctcctacctttctagaccatctcccaaagcccgcagcctttaacctgctgcctgcatcttccctgtgtctccctgaagctgaggagcttccccatgctctgggagctgatcttttcccaagaactcctcattccacccccaactcattccacccccaatccgcttcctccctccgcagac

SEQ ID NO: 393073 - DNA, 168 bp, Homo sapiens
gggattcttctccctcagcctcccaaagaactaggattttaaatacctagagcaggtatttaaaccccagaaaattctgtaaaggggctcttgaggccctatgctcaggccactcccaccttggggtgtctacattcattttcaataaatcgctgcttttgttgcttc

SEQ ID NO: 393074 - DNA, 677 bp, Homo sapiens
ggctgcccgcgaggtcggatgggacttccggcctcacccctgaacggttgctccgggtagctctgtctgcggcggcccgccagcctggcacaggccccgcccggcaccgccttccctcacgtcgtctagggcgtccgcggggcagcagccacgtgattcgcggttagggattccatagttcacgggttacggcacacacgcgttacgtatatatcgaggtgacgtggaagtcccccagtagttgaccttaaacagcctgggttgactggcctggtaactgcgccttcattcgctttttgtagagcaaatgaacgcgctgtctcacgtgtttctagcagcatcccggggaactggccacagatagaaatattccagtttgacacataaggaaatacactctgaaagatgaaagggatgtttctttttttcttttctttcaaattgctcacacaattttaattgcaatagatataatttccaatataccattcaactacaccatttgtatgtgctggagtgagacaggagtattttgattgagtgtccagttctctttaaaactagcgtttgcagttaacgacttggaaaatacaacacaaaaagccatctagccttttttttttttttaatctctatttatcccttcaaaattccctttgtggccatatacatactag

SEQ ID NO: 393075 - DNA, 254 bp, Homo sapiens
cttgattctcatggaagcagcattgtcctgacagtctgatcactgttctagaaatcaagtttttccagctccaagttactgacaagtctgtctgcagctttaaggacagccttgcttagagagctattttctttgaagtggatgtcaaactaacacagtgatcatactgtaacaactcggttttttttttcctttattaaagccacaggtcgacccacaagccacggtcaacccacaagccacggtcaacccac

SEQ ID NO: 393076 - DNA, 561 bp, Homo sapiens
ctaggagtgtcttcactgacctatgtaatggttgatgctgactgtccactgggacctcaactggagctgtcttccggagcacctgtgtgtagcctttgcatgtgacctggacttcctcacacatggtggtcacttcttacatgatggtcaaactgcttagatggcagcttaggctccaaaagctagtgtcatagtaaacaagatgcattgcctttaatgactcatctcaaaactgacaaagctatcacatctgccgtactttatggattagaacaataacaagttcactcagattcaaggggagaaaaattaagccctgacacttaattgtggaggagcaaggtcacagtgtacaagagtatatgcaatgggtgatgctgtacagttatatttggaaagtacagcctgggcacagtggctcacacctgtaatcctagtactttgggagagcaaggtgggaggatcacttgagcccaggagtttgagaccagcctgggcaacatattgggacctcgtctctacgcataatttaaaaattagccaggtgtggtggtgtgtgcc

SEQ ID NO: 393077 - DNA, 546 bp, Homo sapiens
gcttttctccaaggccagtttgttacccagtaaccaggggtgataggagaaatacttaaaatgtactggaggcaggccactcccaaatggactgtggccagccagaggaccagcagggtctgttggatagtcttctgtgccaagtgtgaacacttcagttgctgggtcttgtggagctccagtgagtcctggggaagtaggtgcagaaggagagaacactagggcagcttttatctactgaatattttaacaactgctgtagaggtaacggttggtactcagtgaatatcagctttccctctgcactcttgacacccactccaaattcatgaggcctgaaatatgtgagtaggacaagtcacacacctctctttgctcagtcttcctattttggtgtgtttttaagcaacttagaaactcatctcctaattttttttttcttaaatacctgaattggcatgcaacatatgcaaaatcccactgttaaacaaacttgaaagtaagttgcagattttgcagtacattctgcaaaatgttataaactcc

SEQ ID NO: 393078 - DNA, 396 bp, Homo sapiens
catgatacaatcgagctcggtcccttctccagtgagtcctggggaagtaggtgcagaaggagagaacactagggcagcttttatctactgaatattttaacaactgctgtagaggtaacggttggtactcagtgaatatcagctttccctctgcactcttgacacccactccaaattcatgaggcctgaaatatgtgagtaggacaagtcacacacctctctttgctcagtcttcctattttggtgtgtttttaagcaacttagaaactcatctcctaattttttttttcttaaatacctgaattggcatgcaacatatgcaaaatcccactgttaaacaaacttgaaagtaagttgcagattttgcagtacattctgcaaaatgttataaactcc

SEQ ID NO: 393079 - DNA, 600 bp, Homo sapiens
acctctactttatttcattggctaaagcaggccacaggccagcccagattcaaggggaagggagagagagacctgccccctccttctacccgcccttctaacaggagagtgcaaagtcatcttgccaagctgtgggtatgaggagcagggaatcgtttggccattactgcaaacaatttgtcacagctgtctgtgagctaagcatgttgctttcaatcatcacaagagttctttggggtaggtagtatgattgtgattttacagatgagaaaaccaggtcactgagcatccagtaacttgctcaagatcatgcagctagtaagtggcagaattgggacctaaactggtctctgacgtcaaagcccctttcttccctattttcccttcctgcaagtgtctgtttacaagggcagactagagggcccctcctccctttgcttgttaggcatgggaataatatttttgtggatgatgattatctcataatcagggtggactgagggaggtgatcatcttgttgtggcttgcatgtttactgtgcggggattggacagctgtatttatgagaatccctttgaggtcacagtggtgtgttattga

SEQ ID NO: 393080 - DNA, 138 bp, Homo sapiens
gattcacccacctcggcctcccaaagtgctgggattacaggcgggagctaccgcacccagccaacactttttaatattaaattctctctgttgaaatagcttgtgtgatttcttttaaatgggcctggattgatatgg

SEQ ID NO: 393081 - DNA, 673 bp, Homo sapiens
tgaaattctcccccaccaggaacttcaaggctgcagctaatttacaacccagacaagcccgagatggtaccagcccaattcaccagatggggcaataactcaagataagtcattggaacaagtcacgtagacttgcaccatctcgccccacataccctccataccaaacatcctcttcttaagccctagcattttgcctgagaattccgaagtggttttattaaggcaggagcctgaaccatctccccactgctagcgctgaaaaataaaggcactttccttctactgcaccttgtccttgttattcaattttgcaagcggagggcagctggaacttgtgttttgttggatatttcactaccaaaatatatgaaagagctatagttaattggcttaaagaaaaagtaagtgcttaaatgaaatattttatccagaaaagtagaaatgcactaaaatgccttttaattcttgtaacttgggtaaatttttggtaaataagactagttttttggtttaatgaaagcagcagtgtcatttgatcagcaaaacgtccatgtattaaccttagggcttttgctttggtggtgactgcctaacattcacaaactgtagaaatgattaataaagaaataagatgatggctagatttgtccaatgtttcctgaaaatttcc

SEQ ID NO: 393082 - DNA, 436 bp, Homo sapiens
ctgcctcagcctgctgagtagctgggattacagttgcgtaccatcacagccagctaatttttgtatttttagtagagatgggggttttgccctgttggccaggctggtctgaaactcctgacctcaggtgatccacccacctcagcctcccaaagtgttgggattacaggcataagccaccgcaccaggcttgatcccttttcttgaacaacttatatatcccaaagcaacacaccagaatattcatttacaatgagaatgaaactatccccacaggagcgacaagaactgcatgctgggttctggacagaaatagagttataattaagcattcatcaggctgcattttggcccacttccttgttgctaaaagtcaggtggcactagttcctgaccattgcataccattgttcctgtagataggatttctgacatt

SEQ ID NO: 393083 - DNA, 373 bp, Homo sapiens
tctggaagctgtacatccagagaagggtgcaggcctggtgagtctgggaggggtgtctggtgcggcccttgcagctgtgactccatttctttcagtccatcagtctctggcgagagccggagaggttcctattaattcccacagccgtgggagcctggcatagccccgtagagggcctgatggaggcacaggatgggcgggaatacaggcaggtcctgtggcctgaggagctgccctgaggatgttagcttttgtcctgaggggcacggcaagcctgtgtggggcagaggcatgcgggctgactcgagacgcatcactgctgtggggtgggcaggtgcatgctttgctggtgaatgtggggcagagagggagt

SEQ ID NO: 393084 - DNA, 433 bp, Homo sapiens
caaaagaattgtaaagagtccgccttgcctacagagtaaaggctgcacacctttgtgtggcctctaccatctgcacccatagggcaaaaggagccagaggcctgaggctggccctcgggtggcagtgggaggcacctgcttgaacagtggatgctccactccttacttctttacccagtttatagacagacagttgagctatagtcctctgcacacatggcttttgcttcaaacttttccgcatgcactttcctctgcctggaatacttttccctttttcctgcaaactgcaattccaatactgcctcttccttcagttctctctttttccctgggccaaaagtcatctcccgccttctatactcccacgccccttacctgctgctctcttgctacctcatacttcctgcttgctcttgtagtcacttgtgta

SEQ ID NO: 393085 - DNA, 302 bp, Homo sapiens
ggaaagatcacttgagtccaggaaatcgaggctgcagtgagctgtgatcgcgccactgcactcctgcctgggtgacagagtgagaccctgtcccagaaaaaaagaaagcccatggggctcattcggtttgtactaagctactttccctcaaacgtttatcttcaaaagtagaagacagtcttcaggctagtgtcaaatcataggggaaagtctttagaccatcagcactctgacttgaacttcttgaagatatattaccttctgttattataacaattatgtccctgagtcattaaattact

SEQ ID NO: 393086 - DNA, 424 bp, Homo sapiens
ctcaggtgggactcaggaggctgcagtgcagggaggtctgtgcatcttctgggtgtcgtccttaccaccatgtggctggggatttaggcagcagcccagtggcctcttgctgtggagcgcgggggcagcctcccgggccatctctcccccctacttgcgggttctgcactggccacctgggaggcccctccttgctaaggcccacacggccgtctggggcagctagccacagtgatgcctgcaacctggccgcagaaacaggtgccaagaaataactcaacagcagcagtagcgacaatgtcccacgtccccaggatgtttgcagaaagacatcccccggggatgggaaaggtgcttcccttgtcctggcccacactctgcactcggggtcctgggatgcactgcagcctccagagaagctgtg

SEQ ID NO: 393087 - DNA, 266 bp, Homo sapiens
taatttttttctaatttttgtagagacacagtctcattatattgcccaggctggtctcaaattcctgggctcaagcgatcctcctgcctcggcctcccaaagtgctgggattacaggtgtgagccactaagcccagctggaagttgtttgttttcctgaatatgaaccttaaaagtttagggacatcctctgagacctggtttcctccaggagcttggtagcaatggatcagctcttcccttacacacatttatctaaatccttta

SEQ ID NO: 393088 - DNA, 399 bp, Homo sapiens
cgactctccagcctcacatgtgcttgtcctaggagctgccatcttcaagccaggcccctagcacgtgtctttactatgaagctctgaagcacatgctcaagttccaaggttctctcaggcaggggcctctccgtggcaccatctacaataccttactagtatttttgccttaattttttttaaagagggccttccagagcatataaactgcaagcttagtatccactcctagtggactgtattctaaaacttgcaaactgtgttattcttaccaggattcatataccttcgtattaaatagatattagtttgaaccacatgaaattgcctgatttttgcaaatcaaaaacttatcaggtatcaacagtggcattacggttcaacctaaataacttctag

SEQ ID NO: 393089 - DNA, 215 bp, Homo sapiens
catgctatcacagtcacagtttggtaaatggagtggtccaaaactgttaggggatatctgtttttggaagcctattataaagactgaccctcagtactaatatttttaagcctgagaaaaactcctttatgagatcagaactttttacaagcccagggttctttttccaggatttgtgtatcttagaggaccagacgaacaggctaaggatgaga

SEQ ID NO: 393090 - DNA, 376 bp, Homo sapiens
gagggcagggtcttatttctgattccacagctaggtgagcagtgcctggctgggccagagctggttacactggaacgaatgaacacagaaacaaaggaagaaagaggaaagtgacccaggtgtcacaggtggtagagaatgaccagaggagactcccttccccagcctctgtagcgaaacccaacacagaccgtcctccacgatggctagcccagcccttcccatctggggtctccctggctcatgagtcttagggggccttccagccctcctcaacagtgtgtgagccagtcctctggcttggccaggcagaggttcttgcccaggactctggatcttgggcaagtgctatggagatggggcagggagaattcac

SEQ ID NO: 393091 - DNA, 581 bp, Homo sapiens
ggtctatactagctctcttcacttcctcatcaaatcactcactgcacataaacaaatttcatttaagtacctacagactaaaagaagtccaatccaacagattctagatctcactttccccctcaagagcatctgttagtgttaaccatttggtctgtaatacactttcctacttttctcttcattcgatatgtcttctattcaggatccttctcttcaacatctaaatataggagtttctcaagacctagtagtaggtatcttctcttttcactgtatttagcccactcaactgttttctggggagaattaagaccaaataccctaaggcttccattatgagtatgagtgaacttctgtgcatctagaatgttaacagctaccatctttgacagaattgacaaaaccccagttgagaaaggctgctctataacctcatctacatttcaccttatctacatcctggtttcaattaccacctctatgttaatggataagatttctatgtgtaacttaactatcttctatgaactccagacataaagtgctgttcaaaatgtccaacaggatgtttcaacagt

SEQ ID NO: 393092 - DNA, 406 bp, Homo sapiens
ctctagaggaaggctacagacatttcctggcacgttcatccagacgttagctgtcttgctgaaactccttttttcacccttgaaaaccactggaagaatggccaagaacccagctatcctgagtaagttcacttagagaagcaaaatctaacatgagtggcaaaacggacattggcaccaggagtgtgggtcagagtcctgccccttggaactacatcattgcttgcacagtgtaccccccaggcaccaagagaccaggccaagacccctcagtggccctgggcctctggtcagtgtcttcccgcctggcacacaggcaggccctcataaaacaatgagtactgaaaattccagccttcttggtgggttctcagcaccctgtcatgagccacaccctgccccaggg

SEQ ID NO: 393093 - DNA, 537 bp, Homo sapiens
tgagacggagtctccctccgttgcctaggctggagtgcagtggtgtgatctcggctcacaacctttgcctcctaggttcaagccatcctcctgcctcagcctcctgagtagctgggattacagacgcatgccacctccccggttagtttttgtatttttagtagagatggggtttcattgtattggccaggctggtctcaaactcctgacctcaggtgatacacctgacttggcctctcaagtactgggattacaggcctgagccaccatgcccggccaacactaagcatcttttaaaattgtcttaaattttttattatggacattttcaaacatatattaaagtagagaataataaatggcatgaatccagtttcagcaattgtcaacatgtgagtaatcttgttttgcctatacttctatctgtctccatgctccctctccccacaatggcttattatgaagcaaatctcaaacttcatattatttcatctgtaaatgttactatctttattagttgatttaattaaaaattac

SEQ ID NO: 393094 - DNA, 438 bp, Homo sapiens
cactccatgtccatagggaggaataaagagtagggctcaaggtcagtaatgtttagggaaaacctcttggaagctaggagaatgagaaagaagcattccccaacacatagtccctagaacaagtaatctctcaaaacaccaaaaaaacacattgcctgacagcaccttttgagtggctttctttaaacaccacaagagtgacttactaccactacccctgttaacctagacctttcagaaatctctggaatctaacagcaacattcaccagaactgaattcctagtccatcttcctcaggagatgacaacctcctgaccagctgctgggctcaggagcccctttagagtgctgttgttttctaaagaaggggttgatctcaaatgtgactatctcaccctactcctatgtatatatctatgtatgtttgtgtgtctag

SEQ ID NO: 393095 - DNA, 448 bp, Homo sapiens
ctagccaaaacttccattctaacatcagtttacaagagattttatttatatcatagcttaaatatatgtaacagtagagaaaaaaaattaagtgtgtcaaataagaaaaatattgaataaaaactattataaacatttatctgccttgaacactaaagggttgtcttttagcaaaaagaacagtctccaatttttgcctagctttaaccattgtgaaacacagagagaagtccaaggggtagctaggctctgctgcagtcaagagtctgggacaaccagttccagagctctgcaaacacaatacccagtgggccaacccagcactgtgttacagagctcacatgatccagccccagacctggcttgcagctttggatcatgtagcctttttctagagtgagattcactgcagtgtttatatgagctcccaggtagggcatcagaatga

SEQ ID NO: 393096 - DNA, 201 bp, Homo sapiens
gtgtgactggacgtacgtataatggtcgacgtgtacctggacgacgggtgatactcacccaaaaaaggagcattttaaccaggcctgtttagccagaaaggaatcgccaatcccagtggtccaaacttgagttcctgcaagcctcatcagtgcaggctaaagtgttctgtggcccaaaataaactggaaaggcaggctagg

SEQ ID NO: 393097 - DNA, 356 bp, Homo sapiens
tacaaaactcagatccgaggacaatgagagatgtctttgtcatcgtgagagaggcacaaacagaaaagggctcagctgcagcgcagcaaactgtagaaacacaaatcattccacactgaaggacgctgagagatagtgaagcttacacctttctagcactggaaaaacgcactgtgtcctaaaccaattagatcctttgtgggatagtgggtccctgacagacacctctttctctggaatcttctagagacattcacatgcaaatccctcaaacactttaagactatttcacgtcccccgtgagccttctccaagacttcctctctggaggggaacccaattaatcaacatcctta

SEQ ID NO: 393098 - DNA, 393 bp, Homo sapiens
ttggggagatctacgggttgatggttgctgtagaccttgaggacacacagaatcttcaacaaagtataaagtaagatacttcaggtgtactccattgtagcttcagaaaggttaattctttttcccattattacacatttagtatcaaggggaaaaattgctatttaaaaccatatgagcctttcaagaaagatgattctgctagaattgtatagattctttggttactgaagaatagatggtcttctgtttcacctgaacagtttgatttttttttcctccgatgtgcaggggaactgaatatggaagtagagctggtatagttgaaattgtctgtaaaatagagtgagatggatttggaattcctggaaggcatgcttgaagtataagaga

SEQ ID NO: 393099 - DNA, 297 bp, Homo sapiens
atcatattttggggttttgagggggttagggtgccctccggggcttggcaaagagtgtttctgcaagccagagcatgtccagaagtgccactcagtgtggttgtattcccagtgaattggacaggaatcagggacaggcatctaccagttatttgaacagagagaatttaatgttaaaaattgcaaatctagtattgatgagatgaaaggacaaaagataactctaggttttcttggaagtagcaactgcaggcaacagccaccacctcaatagttcgtatgggaggaggggcagag

SEQ ID NO: 393100 - DNA, 626 bp, Homo sapiens
ctaggtatctacccaagagaaatgaaaagacaggtccacacagacttacatgacatcggatcttcatagcagcattattcacgatacagtaaccaaaaagtcaaaacaacccaaacaactggtgtatctgggccacatttttattgctgactagcaataaaaggaaacaaaacagatccatgctacaaaaacatgatgctaagtcaaaaaagccagatgcaaaaaccccatgctgtgtgattccatttatatgaaatatgcagaaaagaactatagagacagggccaggcatggtgcctcacgcctgtaatcccagcactctgggaggccaaggagggcagatcacctgaggtcaggggttcgagaccagcctggccaacatggtgaaaccgcatctctactataaatacaagaattagccgggtgtggtgatgcgtacctgtagtcccagctactgaggaggctgaggcaggagaatggcttgaacctgagaggcggaggttgcagtaagcagagatcatgccactgcactccagcctgggcaacaagcgagactctgtctcaaaaaaaaaaaaacaaaaaaaaaaccacctctggacagaaaggtggttaaaggttgctgtggg

SEQ ID NO: 393101 - DNA, 468 bp, Homo sapiens
  misc_feature (9)..(9): n is a, c, g, or t
acacttggnaggctaaggtgggaggatggcttgaggccgggagttccagatcagcctgggcaacatagtgagaccccaccatctctaaaaaacttgaaaaacaaaggcaaaaactataggtgcatgccaccacacccagctaatttttgtatttttagtagagatggggttttgccctgttggccaggctggtcttgctctcctaacctcaggtgatatgcctgcctcagcctcccaaagtgttgggattacaggccaacgctcctggccagggatcttatttacaccccaccctagcaaggaccgtcagaggctgctgctcatctagtgtcctcatcggctgtgcaggtgcaaggtgcaggtgtaaggggagctgcctgagtccaggtccagcccttactcatctagcagatggaggtcttccataggtgtggctgtgcagggcttgggtggcaggcagctactata

SEQ ID NO: 393102 - DNA, 465 bp, Homo sapiens
ctccctctgtcacctagacctggagtgcagtggtgcaatctctgcttactgcaacctctgcctcctgggttcaaatgattctcccatctcagccttccaagtagctgggactataggtgcatgccaccacacccagctaatttttgtatttttagtagagatggggttttgccctgttggccaggctggtcttgctctcctaacctcaggtgatatgcctgcctcagcctcccaaagtgttgggattacaggccaacgctcctggccagggatcttatttacaccccaccctagcaaggaccgtcagaggctgctgctcatctagtgtcctcatcggctgtgcaggtgcaaggtgcaggtgtaaggggagctgcctgagtccaggtccagcccttactcatctagcagatggaggtcttccataggtgtggctgtgcagggcttgggtggcaggcagctactata

SEQ ID NO: 393103 - DNA, 1053 bp, Homo sapiens
cccaacagattttcaggagagatatgatgtgttgcctgtgttcatttctaagcatgggaaattagctgatcttgaaggatacctgtagtgtgtcagctttttggtatttatgggtcattttgcaagcatttggaatgaccaaaattctttcgctgtctctgctcaggataaactattcctttgaaatttggtagttcctttccaagaggactatttgatttggattctggtcttcagaatattttataagtttttaaggggtcagctagaatcttgaagcttgtcctagctgattgatctgactggtgctgttgctagatctgttacattctggattttctggggttcctggtcgagagaggagtatagctgacagcattgacctttattctgcccctctctgagactattggaatctcctcttcactttttatgtctggaaattgtatgtaaaattggaacacattgcaaatgcagaggtgactgcttgtttatttcttgtgtttttatccagggatgtggctaggattgtataagagctgaaattcagttttaattcaaggtgctttaaactagactgatctctgggattggagtttcgagaatctggggaaaatgtcttttgtgttactatccaccttgggatttaaagaaaaaggatatattcatgcatgcatgtatgtatacatacatacctgtatatgtgcacacacatacttgcacacgcacacactcgcactcacttctccccattttgcctcaccttgattattcttcctaccaaagcaatacatatttattaaaaattttttctgtcattgtcttagtagtgaatatcctccattaccttatccctcaacgagtaattgtgtttaacatttcaaaacatagtacttagctgagtataagatgaatccaaattttacaaggaagttttgggtgagaaaatttaactatttcatcgtatatgtgtaagtgggaggtgtaaacagcataatatatgctgaaagtatatgaatgtgaattttggaaatctgctttctagccataata

SEQ ID NO: 393104 - DNA, 437 bp, Homo sapiens
tatccactgactgagcttcaagggcacacacactaccgcctgtgttcttaacattttcccaggctccatactatgcatccaccatcaacacttctcaatgaactgtagtaattcccaatgggagggggatgggaaagagtagatgagcaggctcacacagtcctctccccagagaatctagaaaagggatatctgtgtaattattagtgcaggcactccctctgctgctgccctctctgcctagtccattcacatgttaatctacacacatctagagacatatgctacacccagtaccttctttcaagcagactacagagtgcatgggtgtgtgtgctcaggtggatgtggcagaatctggagggaggctggctgaaggtatatgctgcagacagagtagtaagagagtgagcaggtaagaaagagaagaagcaatc

SEQ ID NO: 393105 - DNA, 549 bp, Homo sapiens
agaacttgtgcgaccttgtgcgagtcacttaacttctctgtgcctcagtttcccataaagtggagataatagtacctacctcatgaagttgtagagactagggcttggaacattataaatgcccagaaagtaacctctgggtaaagggaatgggaaatgtcagtgacctttgctgtttactttacttatatctgtactaagttttttacaaccatgtatttattctgtattaaaaagcaactaaacataaaaccaacgaaccattaaaattttaaaaaggtcgactgtcatcacccaccaatgtaaacagtatactgcaatacaattaaaatgttcccatttagcttgggagagtttctataattttatccaaaataatccaaaaacgttatacaaaatacaccaatatgccaaaagtgaagtgaagaagaattaagagttagccacactgcctctcagctcacagagtgaaatcacctcttaaagacatttctttcaacttgcaaaattccacttgaaccactgcaaggcgtcatcagaaagtatcac

SEQ ID NO: 393106 - DNA, 589 bp, Homo sapiens
taattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcc

SEQ ID NO: 393107 - DNA, 287 bp, Homo sapiens
tctctagtgtacaataccacatgcttatgcattgtaaaccaagtgtgtattcctgtgtatagaatttagtagaactgatttctgcttcaagagaagctgcacctttaatttaataaggttgaaatgggcacagaaatttttttaaaacttcctgaactcacagcaacccaatgcaaacacaccatagcattttggcactttctttccaatgatacttcgtttctcttctgtatagttgagatcatttatcctttatggtttgtgtccttagaatttctttccatcaa

SEQ ID NO: 393108 - DNA, 374 bp, Homo sapiens
gttgctctctgctgaatctagatctctggggctctgccagcctgggggagcatgcttggttctcttggtggcatctgtccctcactagctacggaggacctgagccagacatcaccctggctgcggtgttccatgtctcacagatagcccagttcagggaggcgacatgcccaagagtgctcagttagctggtgtcagaactgggccttgaaccttggtctgcccacctccaggtctcactcattcccttctttcaataatttgttagtatttttttttttaactcctgggcttaagcatcctcccacctcagcctccagagtagctgggacttacagacatgtgccatttctcctgagactttgaccagctgt

SEQ ID NO: 393109 - DNA, 510 bp, Homo sapiens
gggggacacggaggcaggagacagcagctgaactaaatatcaggaaatgtgccacgaagctctgctttgcgtcaacaatgatattttcatgttggtgacttcatcattacatgatttgattttgactcttatttatcattttgtaccaatttgctagctagtgaatgagtccttttgatgtcttttgagtttactagatttacagtattgtttattaaaataaattcctagttactaagtgttcgcccccagttaataaatacaacagagtaaaagaaagaatgctacaccaagacctcagattgaattttggaacagttaagaattgaaagactgacgtggcttattctaaaccaacagcaagaacaacaacaacaacaaaaatactttattgcttttaaaatagttttatttttaaattgctgtggttgctacccattttgctgaaacagtaacttgagcaactcagtgactagaaaaaaatcagctgacagcaatcccagactgata

SEQ ID NO: 393110 - DNA, 468 bp, Homo sapiens
aaagtgctgggatacagacgtaagccaccgtgcttggcaacattagttttttaaatatgttaacatcatatattaaataaagaaaacatattgtaatatttaaatttgctgagaggaaatctccagtattctcattactaccaaacaaaaaaaggtaattatatgatgtgatcggtatgttaattaccttgattgtggtaatcatttcacaatgtatacatatatcaaaacattacagtttatgtctcaaatatatacaattttatttgtcagtcatacctcagctatgcgggggaaaaaagagcttgggtgccacttctccagttctggaatcatctacctctagtcctttttttttttttttaaatttaagacagtcccttggtctgttgcccaggctggattgcagtgcctcaatcatagctcactgaagcctcaaattcccggtctcaagcaatcctcccattt

SEQ ID NO: 393111 - DNA, 471 bp, Homo sapiens
cgatttaatattgttgagactttagagaatggatgctagattaaaatagtaattttttcacactttcttcttcattatagtttataaaaatgttattgagttttctgctatactattttctgtgctgtaatgactaaaagtcacaaaataatggatgatagtcttaaatatactgtagattagttaactggagcttgaatcactgaaagttggtcaaatatgttggataaattataggctaaaccattgtgagttggagcaatagctagtaggatatgtgtgatgatttaatttgaaatgtaggatactgctctaatatttatttttttaagtacatatgattggggaaaagaatgctttacaattttggaaaaattagtttaatgaaatatatttttttttcctcgtgttcttagccttcattgttaaacacacaaagaatgtaaataaagactggaggagttgtttatg

SEQ ID NO: 393112 - DNA, 362 bp, Homo sapiens
tcaaccagcctcttcctgtcttgggcccctttatgcccatcatctcattgatattcacaacaacaggtgaaaccgggcctagggcagtggaggcagctgccctgtgtcacacagtgggtctctctgactctgctgtgctctgcctgggctctgtccagctctctgtgccatctctatggacataaaggacactaaggacataaagatgctactttgatttgctgactgactagggagaagtagcctgttacagggagatcagtaagaaccccaggagtttgtcctgagtccccagagaaaggtacagtcaatgccataagaggcaagtggagcaggagagggagagagcagtaaggactggt

SEQ ID NO: 393113 - DNA, 288 bp, Homo sapiens
gaaaagataggatctgtatcttatacttttgttaagtgcaattttaggtatttaatattatttatgtatagtattattgggactttaagcaatttattttatctctgattttctaccaagagggaagaaggaattaaacacaaatgttaaatgggaagtgtcttctacccagaggaatgcattcatgacttgtgagtccaaaagggaatttaaaaaatcaaatacataccaaattatccaaaagaaatttaagagattgggattttagaagataggctagctttttgg

SEQ ID NO: 393114 - DNA, 169 bp, Homo sapiens
tactttcaatattgttgtgtctcgggaataggaggcccgaagagaatgaaagagacagttagtggagcagtcagaacacacaaaacatttatctatgaagtttacttaatagatatgtcttatatgtcttatatgggtttggtttatggtgccctcaaatattacaata

SEQ ID NO: 393115 - DNA, 365 bp, Homo sapiens
taggtccgcttggtctactatatctgtctctcagctggttcaggaagggttcaggataagaggaaaagggagattctgtatcagctaggaagaaggatctgaattcagtctgggaataagaacgggagtaaattaaaccatggtttattacgttaagggttacagggaaatgtagcaaataggatcatttttaatttgaaatgttgttttctatatatcataatttattttaataaaaaattagatttttcaatatgaaaagaaaaacaaagtgagtttatctctagtaatttaaatctgtggcttaagccaagatgatccacttagtagtaagttatttatgtgcctatgggcagcacatcatt

SEQ ID NO: 393116 - DNA, 353 bp, Homo sapiens
tcccccaatgatcaaagttgtttgtgtcccgcagctcaatcagacttctggatgccatcaaggaggtctgcatgacctaaggatcattgttctttgaaaggaaaacaagttcattaatcttactggctgccagggttaggatgcaaagttaatcaattattagtgactaccgtctaccgaatgactacgtgcaagcagtcatgcatggaggaagaaaaggacaaagagaaaggaaaataagtaaaaaacaaacgtttaatgattttgataatataggctcagttacatcaccacaaacatgataagtatgtcaggtcatgcatgtcataattagctcaatttccactttgcct

SEQ ID NO: 393117 - DNA, 326 bp, Homo sapiens
gcgagttagcgggcaggcaacgctggcccacgacggagtgcaggagcactaacagtaccttagcttgctttctcctccctccttttatattcaagtacctttttatttctcccttgcgttacaacctttctccctgcagcaggccatctttccccacccgtctttgtaagatcttcagagagtgggcttgccaccaccacccggccttttctgccagcccttccaagaaggaaagcatcttgttctcagtgaacccaaatggactctgtcctgctggtgggcattagctctgctggggttaggcctgggtgcccgctaaaccagag

SEQ ID NO: 393118 - DNA, 192 bp, Homo sapiens
agttcgacggagactctcatagagttcaacttggatattcaacaggtatcacaaacttaacttatctaaaactaagcaccacattctttctctccacctccaggaagttgattttcctagaatttcgtctgcctcaaaaaatgataactccagcccaaaactcctggaggtggagagtctccgtcgaactgg

SEQ ID NO: 393119 - DNA, 306 bp, Homo sapiens
attgttaaacattcttattttgtgacaattgtagatttacatgtagttgtactaagtaataaagatcccgtatactcttcacctagtctttctccatgtagcatagtacaatataaaaacgagcaaattgacattcatacaatcattccaccttactcagatttaggcagttctacatgtactcctttgtagggtgtgtgtgtgtgtgtgtgtgtgtgtgtgtgtgtgtgtgtgtgtgtgtgtgtgtgtgtgtgtggtgtggagggggggtaggagggagggggtggggaataaaaaaggaaaaga

SEQ ID NO: 393120 - DNA, 366 bp, Homo sapiens
aagggctgagagtgtggaagggaaagagaattaacacaactttttacagtgttcatttttgaagactcacatgagatatttctcacatctcattactatgaaaaaccaatttttttcctcccctaagcaactagtagtttcttagcttatggactctaggagtcaagtaatgcctgtgtatctctctttgctttggctgccaggacactctgagaccatgtttagcccactgcttgacatatggaaccttatcccgccatccgtcatgttcccctcatcagggcattttctgctttggcatcatggtgtatatttctaagtcacttctcagccctttttaaatgaagccaggtataagtgccttta

SEQ ID NO: 393121 - DNA, 419 bp, Homo sapiens
acacagatcagtatgaacccaaagatattatatatctgatatgtaccaaattcatgacagttatattcttcactatctttgagccaggtcttgctgtgtcgcccaaggtggagcgcagaggtgtgatcaggattcactgcaactacaaactcctggactcaaagcaatcctcccacctcagcctccctagacagctgggattataggtgcgtgccaccatgcccagctaatttgttattttttatttataggtagagacaaagtctcgctatgttgccctggctggtctcaaactcgagcccaaagcgggtggtaaactccatctaaggctaaataccggcacgagaccgatagtcaacaagtaccgtaagggaaagttgaaaagaactttgaagagagagttcaagagggcgtgaaac

SEQ ID NO: 393122 - DNA, 364 bp, Homo sapiens
tcctggcaaggaagttacactggggctcaaatcaggctctagcagtgcaaggttagggaaggggcagggcctgcctgagctgtctggggtgggtgcaggctctgctggggttggcagagaagaaacaagccaggtgctccagaatttgccaaactcagatcttacacagaatcttataaagatctaaacacaggtttggagtgaccatccctcacatgcagctgggcactgactcctttcccatagatccagctcacctctggggactctggtcaacccaggggcctctcagtcacctgtgggaatacccagtgcctatggtgcaggtcagccttggaccacaccttccctaacctaaccccca

SEQ ID NO: 393123 - DNA, 515 bp, Homo sapiens
tactttgctgaatattgcctagtgaatattaagtatttattctcaccttgcagacatgaacttgtgaattcaacacgtgaagatttacaacttgataaaccagcttcaggaggtaggtcttcagtcttaagtcagattagaagattatgtgaaataattatttaatgcttaacattgattttttaatggtatcttccacatgaaataatattcctctaacatttaattacatgccaggacaggagaattcatgttgtcaaaattctaatactctctagaacagtaaactcattttatttgtattaacccattataaatacatgtaaatgttgcatttatgggtagacagaactaaaagaacaatatttttcctacttttgagatgcaaaagttgtctggcataatgcattgaacaggttattattgaagcttgcaccagacaactgaacaaacattcctcaaatgtccatgatacccaggacataagaggcttccttttagagtatggagccatg

SEQ ID NO: 393124 - DNA, 457 bp, Homo sapiens
agagtcaaagagcaaagattatcacatatttaaaggaaataagagcagatgaaagctgttcctgaggaacgaagtaaagagagtttgagacagtggaagatggaacaggaagaaaaaaaataagataaaatggtgacatctcttaaaactgttttggaagagtcatttacacactatggatgaacagcaatttattcctggaaaatgcttgttgcccaggttgtgcaaattctcagttatggatagatttggttattgatcagtcatactgctttcaagaattttaatgttttgatttcttaaaaagttcccatgtatataaacaaagtccatttacttgttggcattatattagcctcagggtgtttggaggacttgcatacttggagacaagggcattccagacgtcggatgttttcaggacaaccctctcacccagtgagacagattgtatgtt

SEQ ID NO: 393125 - DNA, 632 bp, Homo sapiens
attttaatacaagagcttctggctcttgaaatttactttaagttttttaaaacaatgaataacattaagaggttggaatcattgtgttttggagttttttgggtttttttctcacttgtcccctaagaagttacaggatgccacctctgcaagcagatttggagttttaaaactacatgtttcagatctgttcaccgctgattgactgatgcagccaaatgtaggttttcctgatcagcagatagcctttcatctggtgattggtaggctgcgactcctttcattttatggctataccatcctgtaggaccaaggagtcttctccatcgagccagcagatgagcaaagaaaaggtggagaaaacccattacctcttaatcctaccctaactgtagcataaattgcttccactggcaaaaactaatgacatactggggctgacacagtccttgctgggggacctggaatctgtcctttcatctgagatcccattgaatgtcctataccaaatcccattccaacaagtcccaggtatattccactcttacgggctgcttctcatttcccaaactgagcctggagacattagaaaatagccctaccaactcttcattcctttgctgagctcctgc

SEQ ID NO: 393126 - DNA, 114 bp, Homo sapiens
ttagtccaatctgaaagaagtaatggagagtacttgaggtcgtgctcgagaaccttcctctccacattgccacagtcagaggctctgtggcctgcacagccctccttgtcccct

SEQ ID NO: 393127 - DNA, 516 bp, Homo sapiens
aactaatgttcatctcacactctcagaaaaaatagttgtttgttcattaaaataacctaccatcccctttgccctcaatttcagatttataaaacagaaaacaaaatggcattgtctacccctctccaggtgaatagtatggatctaaaaatgtgaacttttgaccttagttacctaaaaagtattttccttttttttcttttgttgagacagagtctcattctgttgagcaggctggagtgcagtagcatgatctcagctcactgcaacctctgcctcctgggttcaagtgattctcttccctcagtctccttaacagctggggctacgggtgcccgtcaccacatctggctaatttttgtatttttagtagagatggggtttcaccatgttggccaggctggtctcaaactcctggcctcaagtgatccacccaccctggcctcccaaagtgctgggattatagatgtgagccactgtgcctggccaaatttcaaaggatttaaatcatacaaa

SEQ ID NO: 393128 - DNA, 597 bp, Homo sapiens
tgagattccgtttctctctctttctgtgtgtgtgtgtgtgtgtgtgtgtgtgtgtgtgtgtgtgtatagtaaaattacggagttcatgacctcctggagagatgactagcaggaattgcaatggattctgaaaagatttggagaatgtggatatcatgggacgaagccaagacttgcacctggagatgaaggttcaagctgtgttttccaggacgtcatccttggcaagtcactcaacatctctgtgccttaacttcctcatctgtacagttggaaatataacaatgcctgccctgcttatctcatggagctcctgggaggatcaaaattaccagtgtatatgaccatgccagaaatcagttaagtgtgaggcacgttaaagcattttaaagcattatgtttggaaataatttcaagtttacaaaaagttacaaaatgagaaatggtacaaagaatattcatattcattttatccagatttacttattgtttgtagtttaacccatgtattatttattcttattctctgtctcatgtatatatactatatggacatgtggttatatatgtatgtttatacataattttttcctgaac

SEQ ID NO: 393129 - DNA, 123 bp, Homo sapiens
ttgttcagaggatccctcaaaaccgtatcagaacataaacaactctttttacttcgagcccaactctaatatcaaggtctcttgccaggctgggcatagtggctcacacctataatcccagca

SEQ ID NO: 393130 - DNA, 429 bp, Homo sapiens
catgagccaccatgcctggccagcagatattttcttatgaatatttttattcttagtatactgcaggatttggtttttgtttgttgacatttataacaatttgaatttttactgtcacccttaaaagatgcctaaaagacatgcagaagtgttgtcaaaaggttaagtcccaacagagagacaagataatacaaacgttttaggggcatgtgcaaggtgctccgagaaaaggtggtaaactgattaaccctgaggagagatttcttttttaagtctgatgaaggcaggaggagcatgaatacccaatgtgctcattatcaagtcccagaagtaccacatgctctgttaaatatttctcctgttttcaagaggctcattttgtccagtcccaacagacttcagcccttaaaggaaatctgggagatacat

SEQ ID NO: 393131 - DNA, 959 bp, Homo sapiens
aaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacag

SEQ ID NO: 393132 - DNA, 869 bp, Homo sapiens
gactcaggacctctaagtagcatcaaggtaccacagcaatctccctgctatagcacttcatgcagttccagcccaccccgatccaagcacatggcagaactgtacttcctggatctcctgagttatacaggaatatttcacctcttccctattttaaaaaacaacctctgcaaagacaagatatgtctgccatgtgcctgaatgtcaaaatatttgaataaaattgaaaagttgacactgaaatccgatatgacttcttcgacatataaagccagagggagatggccccaagaacaccaggcaccacctgcatttacatcatcgaaatgaaaaagtgaaaaaggaacaaatgtggtctcattactttccataaagggaaagctctttaccacaacaatgcctattataccagattatcaaacacagaatcacattgtaacttctggaaagtatggaatatgtatacacagaacagagccaaaagaactccagacaggtatgcctcaccctcagggactcatgtgttacagaaaatgttgggaaaactgaataatagggacaaaagaaactcgccatgttaaggttttctaaactgaaattattcttacttgttttaatttacttttcttacaatgcttaattctcatattttttaagtaagttgcatttatacctttgttaaatgtaggccttttgatataagaagtcagtttggcagaattgcattgatacatatttgatgacattcgttcaaatattttcattattccaaatagggggaggattccataatagcccctggtttataaaaaatcctaggttcacagccgtggatgagaatgagtgaaagtacctaaaacctactattt

SEQ ID NO: 393133 - DNA, 776 bp, Homo sapiens
gactcaggacctctaagtagcatcaaggtaccacagcaatctccctgctatagcacttcatgcagttccagcccaccccgatccaagcacatggcagaactgtacttcctggatctcctgagttatacaggaatatttcacctcttccctattttaaaaaacaacctctgcaaagacaagatatgtctgccatgtgcctgaatgtcaaaatatttgaataaaattgaaaagttgacactgaaatccgatatgacttcttcgacatataaagccagagggagatggccccaagaacaccaggcaccacctgcatttacatcatcgaaatgaaaaagtgaaaaaggaacaaatgtggtctcattactttccataaagggaaagctctttaccacaacaatgcctattataccagattatcaaacacagaatcacattgtaacttctggaaagtatggaatatgtatacacagaacagagccaaaagaactccagacaggcttttcaaaaaatcttctcccttcccagaagctgccatgttactcataaagcaagctattctaaaagcaatctttattctcttccaacttgttgcttctacgataatgttagccaggaaaccagatacccaagctagaaaactaaactcttaatgagtgaaggtctatggttgctgtcaatgaacgagacagggtctccctctgctgcccagggggagtacagtgtcacaatcatagatcactgcagccttcaactcctggactcaagtgatcctcctg

SEQ ID NO: 393134 - DNA, 109 bp, Homo sapiens
ctaagatcacgctattgcactccagcctgggcgacaagagcaaaacttgtctcataaaaaaggaaaataatttattatagaggagagtggtatattaagaagtttgaca

SEQ ID NO: 393135 - DNA, 474 bp, Homo sapiens
agggtagcagtgggaccttctgctcttaacctggggccagtgctggctctcagaacagtcgtcagatcagggcctgcttttcaggggatgcggcctttgtccaccaccctgcaggtcctggaggatgaatgtggctctaagttaactgaatgttgacaacaaaaggtctgcaaaatgggcagggcaacgccttggggaccctaaggagatggtccccgcagatgctgttggggcctaatgttttctgaatcctttttagggtcacgtgcagtatagagctggctcatctacgcctctgccacagcaaccctgggaggcgaatcttggcatggaaaaagtgaggctcaggaagattgcgtgacttacccaaggtcacgtggcctgtaggcaactgaaccagtccttgaattcagagctgcctgaatcaagctcccacattttcaacatgtgaccacactcctccaagctgagggc

SEQ ID NO: 393136 - DNA, 411 bp, Homo sapiens
aaactgctctgtctactctctcaaattccatcctacacaccaattttaggttgttattcatttaactaggtgatattgaccagcatcaagacttgaaattagtaagaaatgttctggccgggcatagtgactcacatctgtaatcccaacactttgggaggccgaggcgggcacatcacttgaggtcaggagttcaagacagcctggccaggccaggcacggtggctcacgcttgtaatcccagcactttgggaggccaaggtaggcggatcacgaggtcaggagatcgagaccatcctggctaacatggtgaaaccccgtctctactaaaaaatacaaacatttagccaggcgtggtggtgggtgcctgtagtcccagctacttgggaggctgagacaggagaatggtat

SEQ ID NO: 393137 - DNA, 744 bp, Homo sapiens
agcttattaatattttgctaatttgttctcaggctattgttaaatagttactcatttcagtggtccgtgctttttgagaaatataattttggccttggtcctgtaaactgatatctaatttgacagaatagcctggaaagaagaaaggcctttgatgccaagcaagagtttggcaaagtactgtgtatgtgtgtgtgtgcatgtgcgtgtctgtttaaatctaattgtggcaatattttattttatatgagccttttaagtaatggttcatgtacttcagaaacattgtgtaaatttcattattatgagctgagatagatagaatgaatgcttaagtttccaccttgtcttcacttgctgccctcattatagttctaagcaatttgtttgggaaaacgtgtagttcatagaaagtccagtgaaattgaaggtaaattcaataatatacttaaatattcaggcatgttgtggttcctgccacttttcagttttatactttcatcttctgggctctactacagcatttcccaaggtatttgacagcatatctgaagggtcttaatggtctgaggaagaaaaaaaaagattctagtagccagtttatttgagatgctaagtttaaaagagttaggttggttttgatatttcagcactttttagagattttaatttattattaatatgttcatcggtgttcagtaagaggataataaaagagtttgcataatttaccaaacttttgac

SEQ ID NO: 393138 - DNA, 277 bp, Homo sapiens
tgacctggagagtgttgatatttttggattagctaatgataaagttaatttccttagtcataggtttgctaaaaatggcttcaacttggagcagccactgctgccatcacaagtatcccttaaaactgcattctgcccttgaaaaaggaataaaccttatttaactgatctttcccatctgttgctgtatcagcaatataacagaaataagtacggaatttttttagtaagaaagactgcttagcttattatgtcctgttaagacatgatcagaatg

SEQ ID NO: 393139 - DNA, 637 bp, Homo sapiens
cccaaaatagctctgtcctcatgggttcctcaccccctccctccagaacagcttgagacagtctccaagctgagctggatgggctaccttagaacccgtaaaacaaggggctttgcagtgacaggagcaatccaggacacctctatgtgagaccctctattttctaaccaattcacgaatggggaaagccgctgggaggtaatggagtaaaggataaaagtattatctttagaacagacagacgagggtttggattctactagatggtgactgtatgaccttaaagtagttattctctctaaagctcagtttccttgtctgcaaaataggacagctgtagggttgagaggaagcatatatagcagagccaatactgctgctgtgacatagtagacggtcagggaatgtttgttagttgagtactcttatttctctatcaggtaaaaggttggcccaaataccaatgaagttccttcctacttaaaagtaagtccaaggctgggtgcagtggctcatgcctgtaatcccaatgctttggaaggctgaggcaggaggatgatttgaagccaagagtttaagacgagcctgggcagcagagcaggaccctgcttctataaaaattaaaaattaaccaggc

SEQ ID NO: 393140 - DNA, 460 bp, Homo sapiens
agctcctcaaagcaacctggaaatatttctccaaaggcagtccacctaaagaggtcacctgaggctcatttccatattcaaacatgctggtgaaatctgtggaaattatcattcctggaaatttttgctcaatctgtgccagatgctgagctgtagattccatatattttgttatctcgattttgatccaggctagaatatctaatttgtcctcgttggcattgaaattacataggtaccaatttttctgaccttataaccatcctacaatggcttagaatcccagggtaaaggcaaatgaggagacttaataaccactatgtttttaatcatttggtgcttactagctgttaagtactacctaatcatgttacctgtattagcttatttaatcaccacaatgactttatgtggtagatgatataatttttctcattttatgaaaaatgaaattgtagcc

SEQ ID NO: 393141 - DNA, 1579 bp, Homo sapiens
gccaggatggtctccatctcctgacctcatgatctgcctgcctcggcctcccaaagtgctaggattacaggcatgagccaccgcgcccggcccaaggattcttcaactttacataggatactatttagaatacaaatcaatacgcataagctcatagtcttctcttttgtagtaattaacaagcacttcccatacatttctttgcaactctttgttaccacaaagtggttttccactaggaaaaataggttaggtggactatgatcaaaatcatgtgagaccactgctctaaattattacaaatcctaccttatgcattaagtatcaatgtaaatttcacaattaagacctctttattctataaaatatataagaggatacccagaaacagtcccatagaaaagcaagtgattaattcagcatgttatatgctgctataatcagtcaaaatatgtcttcgaatgcaatctaagccaacaatataaaaaaagtcagaggcagtgaactaaggacctactaagagtacaaaacgaagtcacaagtaatttcacccttgacgcctagcacaccccttgcttctgttcttgttctctattcttagcatctctctgaggtttattaatggttcctggatctcccagctggagcttctgctgaatccaaggcactacccttatcaaaagaaagagatgtgagaagtaaaacggatacagacaaatttaaaaataaaaagaaaacaacagaaatgaccacaatgtgaaagagtaacaaaaactacaaacagaaaaggtattagagagttactgacaaaataaacggcatgagaaaaagtaatacagactttttaaaagaccaaaaaaaaaaaaaaaaaagaggatgaacctacaagcactaagggatttaaagccgtccatttctaacatgtagtttgtgaaaatgttagcattggaggaatgttaattgaatttcatttaaccaggccaactaccaatttacaggaaacaaaacggcaaatgaacatggtaaatgacaccacagggatacagtcatcaaaatccagactgggaaaccttccacaaacaaattgtaaggcaaaaaaaaaaaaaaaaagactaagaggaatctatattttaaaatagattaaaaagacacagcaacaaagtaacaatttgtaaactttatttggatcctcattcaaataaataaatataaaaacaaggatgatctttatgggaaaattaggaagttaaacactgactagatatgtatatacacatatttttagagacagggtctcactatgttgcccaggctgcattcaaacgcctgggctcaagcgatcctcctgcctcagcttcccaagtagctgggattacaggcacatgctgccatgcccagcttagatacttaataatatttaaaaattactgttaataatttagataggtgataatggtgttgtagttatttaagattctttatttttcagagacgtaaactaaaatacttatgaataaaataatatctaggattaaaaataattccaggggttgcagcacagataaaacaggatcagtta

SEQ ID NO: 393142 - DNA, 1575 bp, Homo sapiens
gccaggatggtctccatctcctgacctcatgatctgcctgcctcggcctcccaaagtgctaggattacaggcatgagccaccgcgcccggcccaaggattcttcaactttacataggatactatttagaatacaaatcaatacgcataagctcatagtcttctcttttgtagtaattaacaagcacttcccatacatttctttgcaactctttgttaccacaaagtggttttccactaggaaaaataggttaggtggactatgatcaaaatcatgtgagaccactgctctaaattattacaaatcctaccttatgcattaagtatcaatgtaaatttcacaattaagacctctttattctataaaatatataagaggatacccagaaacagtcccatagaaaagcaagtgattaattcagcatgttatatgctgctataatcagtcaaaatatgtcttcgaatgcaatctaagccaacaatataaaaaaagtcagaggcagtgaactaaggacctactaagagtacaaaacgaagtcacaagtaatttcacccttgacgcctagcacaccccttgcttctgttcttgttctctattcttagcatctctctgaggtttattaatggttcctggatctcccagctggagcttctgctgaatccaaggcactacccttatcaaaagaaagagatgtgagaagtaaaacggatacagacaaatttaaaaataaaaagaaaacaacagaaatgaccacaatgtgaaagagtaacaaaaactacaaacagaaaaggtattagagagttactgacaaaataaacggcatgagaaaaagtaatacagactttttaaaagaccaaaaaaaaaaaaaaaaaagaggatgaacctacaagcactaagggatttaaagccgtccatttctaacatgtagtttgtgaaaatgttagcattggaggaatgttaattgaattgtgaacaatttcacttagggtccagttatatccttggggacaaaagataaattttcatttaaccaggccaactaccaatttacaggaaacaaaacggcaaatgaacatggtaaatgacaccacagggatacagtcatcaaaatccagactgggaaaccttccacaaacaaattgtaaggcaaaaaaaaaagtaacaatttgtaaactttatttggatcctcattcaaataaataaatataaaaacaaggatgatctttatgggaaaattaggaagttaaacactgactagatatgtatatacacatatttttagagacagggtctcactatgttgcccaggctgcattcaaacgcctgggctcaagcgatcctcctgcctcagcttcccaagtagctgggattacaggcacatgctgccatgcccagcttagatacttaataatatttaaaaattactgttaataatttagataggtgataatggtgttgtagttatttaagattctttatttttcagagacgtaaactaaaatacttatgaataaaataatatctaggattaaaaataattccaggggttgcagcacagataaaacaggatcagtta

SEQ ID NO: 393143 - DNA, 163 bp, Homo sapiens
tgcacacactcttgcacacgctctcccacaaccttcatttgaaacaccatcacctcttgccaacctcctaactggtctctctgcccacagtgttctagctctccagtccgctcctgaacaggcagccagagatatccttccaaaatgcacattgaatcatggc

SEQ ID NO: 393144 - DNA, 329 bp, Homo sapiens
tgtcatgcacacaaatattctccaggatagaccacaggctaggccataaaacctcaacagaatttaaagagaaatatacaagtatgagtagggagtggtggctgacacctgtaattccagcactttgggaggctgaggcaggaggatgcttgagccccggaggttgagaggctgcagtgagctgtgaacatgacactgcacaccagtctaggcaagagtgagaccgcatctctatttgtattaaataagctatattaaaaaaaaattacactcctgaagacctttcaggcagggaaattctcaggcaatttactcactgtagcttcatg

SEQ ID NO: 393145 - DNA, 1027 bp, Homo sapiens
gaggaccaatgtgctccagagggcaactcctggtcaaggcaggaaaacagaagaaaccagcatgaaatctgttcctgagacaataggaaagcaaggccatgagtactggccattgctgctgcagagagtagaggggttgggagggtacttgaaggggagaaagggagaaagggaagaggatattgatgttatcctcagaggctatcctcagatgtgtctgtaaaaccaaaagtggttctgtttaaagaattaaatcttttggacaaaatagaagtatcaaagactaagaggaggaaaatcagaaggggtctgtctgttggaagaaaggatgttaatatctttcttcacctgttaacactgttcccttgtctcagcacccctgctttcctctgctccatcttcttccttccctctttcttcttggccctagtgcctctcaccttcctcccatccctgtgtccctgctcttccctggccttcatgatgcatgctgtgaactggaaagggacacctaagtgcctttgctctcagggtgaaaggagttagtgttctaatttctaaatcttcccgtgatatttaatttgattttattttaataatatcctttatcaaatgttttgttcatgaagaatacttagatataagagaaaagaaaaccagaataagtaagtataagaaaaagaaaaccagagtccaaatgaatggatttaaataaacgaatttatgaatagacacacaagcaaatgactcaaaagccaagcctgaattttgaaatcatgattgtttcatggtagaaacccagtaactttcccatcttctcatcttaccatcttcccattttgcaactggccaggactgaaagtggtgaggaagtgttctgcacaggaagggtccggtgggttttcctggcaggtggcagcctccagtcttaacccctaaccatttccctctacctggcaagcatattctgggctttgtgcaggaggaaccagagcagagcagagcagtttccaaactgttccagcat

SEQ ID NO: 393146 - DNA, 497 bp, Homo sapiens
tacctacctcttcacctccttcacatggaccttatttcatagttagtctcgaaacaaacagtgaatctgttctttcctggaatcaaatgaatagggtggaggtaggaggagaagaggatcacagcaggaagagaggaggcacagggactttgaaacccgtcctcctccacggtcaagtgccttacctcctcctaccaagtgcaggggagaggggggaattcaaggtttgctgccttccctaaatgtagaattttttaaagtattattttaaaaatactgtttacatttagttacttccctatttttgctgatgcagacatttttatacagacatttttagcaaatgtcttttaaaaaagtgaagaattttataactgcagaatttctatgatccaaagagccaggggtgcacaggcctttgcatcaggaaggggaattcagagatggatcctctcatttgatgggtgagaagactgaggcccagacagaggtatcca

SEQ ID NO: 393147 - DNA, 304 bp, Homo sapiens
aaaaacaaacaacccatggagagtgattctgacatcaaagtctaataatgttacatgcagatgataaaactaacctgctcccttgaattctagatgataggatcaacacaagtttgttttgttacgctgaaggtctatataatcatgtaactagctgtgcaattaagtctgctatgaaaatgcagtgaaaacacctgcaaacaacagtgtgtggggatgtgtgcattttaaataaccagaagtcattttcaaaagtgaaagaacattgttaggaagctggataccacacctaagtggtttaacg

SEQ ID NO: 393148 - DNA, 161 bp, Homo sapiens
gggtatgaggggagtgggggacaatgagaaagaattagggttaaggggctgtgctatgagaggggctgaaaataagggcgttggggaaatagagtgagccggtcagataggcggtgggggtgggcaagtgggatacttgggattgagatgatgcagaggtt

SEQ ID NO: 393149 - DNA, 229 bp, Homo sapiens
cagctgctgtggaaaatatttaggcagtttctccaaaaagttaaacactgagttaccatatgacctcgcaattctatttctaggtatatatccaaaagaaatcagaggatcaactacttgtacaccactggtaagagcagttttactcacaatagctaaaatgtgaaaacaacctacatgtccattaacagatgtagtatacatataatggaatatacagccttaggaa

SEQ ID NO: 393150 - DNA, 220 bp, Homo sapiens
cctgccttctctttctccccacaataattcccaagaaaatagtcatccaaagggactctttgccctccaagaaactgagttacggcctgataggttagtaacaaagacttaggaccttctcgtggagatggtggtggcctttcttcgcggccatgcaagtcacagagaagcctagatgtggctacagttttaaggagcaaagtaaaactccatccctcta

SEQ ID NO: 393151 - DNA, 322 bp, Homo sapiens
acctgaacctgaaccacccccaccaccacccacacaacgtgcactggaaagaaacaattctcaaggaaaagactggagatgcacccacctttggttccaatattttcatgactgtgccttgcagaatcatagttgtggtgtctcaaacacaacattgaaaatgaaagagtcaggccaggtgcggtggctcacgcctgtaatcccagcactttgggaggccgaggagtttgagaccagcctggccaacatggtaaaacaccgtctctactaaaaatataaaaattagctgggcgtggtgggacacacctgtaatcccagctac

SEQ ID NO: 393152 - DNA, 311 bp, Homo sapiens
gggaagttttaggtagctgggagaagaggggcttctggctggcagatggctggcggttcctgtgctgagtcctgaacacgtaggccccaggggagctcagcagcagggctgtgcccccccaacacacacacacactcggcagggaccagaaggcagctccagggccccactgccacctggaggcttggggtgtggcaccctcagccagaagcagtaggggactcccaaggatgtggaggggcagtgaggcctgggagaaggcccaggctgctcgcaagcccggcctctgcacggatacgtttcagctcacg

SEQ ID NO: 393153 - DNA, 187 bp, Homo sapiens
tttgaggaagctgggaggaaaaggccttctctgcaaacctgccagcaattacagaactcactcagactctgcctggatgcaggctctggtttatgtctccctttgggacatctcttctgctttatttgaaacttccggcttcattaataggtactcttaatactcttatctcagcatgccttctggg

SEQ ID NO: 393154 - DNA, 248 bp, Homo sapiens
gagcctggagccaggatcagacctgccctggtcccctccccacccctacctgataggggagcaagattgggttctcccaaggacctggggacttcagcaggacacacaatctgctactgatggcttctgacccccgagggcaagggcttctaagccggggcgcttgtcggatttggagagtgaggaatagcataagtgtttttgctctgggctggatgctgagcacctgcgggaggtgcgctgggcac

SEQ ID NO: 393155 - DNA, 464 bp, Homo sapiens
cacgaggcttaccagctagggaggaaggaatctgtaatcattttagtatagagaggaaaaaataatctgagcacttgtggtccctccaaaggcaggattatattattgatttttagtctgttcaagctgttcaagatcttctcatttaaccccctcattttacagcgctggaaacgataacagagaaggaacgtaagactttcccaaaggcacatagctatttgtaataggactggcatgtgtacagttatatgaaaattctactaaaaatcattacaattataaataaaattgggtggagggtggagaatcaaagttgagggttcaggtacctgggataccttaggtttgattctccttcctgtcagtgctatatatgtgacatgattgtacatctcctatacttactctcccatttacattttttcaagaaatcatcttagggactacctcaaatcctgtgc

SEQ ID NO: 393156 - DNA, 366 bp, Homo sapiens
cgacaacaacaaaacaaaaaaaggtaggaggttaagaaccactgtttcggtacctggaattaacataaacagcagatcaatctggaagtaatcaacaagtgccaacaagcctagagggactaggccagaggcaaaaactatcctgccaatgctttccacaggataactaaggaaaacttaatagctactttttaaaaattcaagtgaaaatacctgttaagatggaaagaaactgacttgcttacaacttagattatctactttattgaacacagatgtatcaattagaaaatcagcactgttttataatacatactgaaataatatctgggcatattagaaaaactaagtcaacatactctctct

SEQ ID NO: 393157 - DNA, 478 bp, Homo sapiens
  misc_feature (50)..(50): n is a, c, g, or t
gcgaattcactagtgattgtgagctgagatcgcacccagtcgaacttgtnttcataggctacttccagtcaatgtttttccacttctcatggagtatgaaaaccttactattctatagatgatctctttacccttcttccctttatcccataatgttttggttatcttatgtattacatttacatacattgaaagctctatcagacagtactggctttgtttttaattgtcaaacatattttaagagacttgcagagccatctgtaacagatattcgccgtttctgtaactcttgctttataatgttctgggtttccttctggttaacacttcctttctgcattaaaaacttcttaagcaattcttttttttttttttttttggagacagaatctcactctgtcactgaggctggagtgcagtggtgccatctcggctcactgcagcctctgcctcccaggttcaaccaattctcctg

SEQ ID NO: 393158 - DNA, 342 bp, Homo sapiens
gagatcgtgccactgtcctccagcctgggcgacagagcaagactctgtctcaaaaagaaaaaaaagataaaacaaagtaacaaaatatgacctgtagagagcttttttggattgggcgttcagggaaacctgctttgagggggtgagattttagcaaagatctgaatgatgataataataagtgtgtcgcataagaatattctaggcagagagaacatgagatgcaaaggcgtggaggtaggtaagagcttgggtgttcatggaacagcacagaggtcagtgtggccagcagaagatgccacagagagagtggggagagttgaagttgagagggaggccgcc

SEQ ID NO: 393159 - DNA, 358 bp, Homo sapiens
tgtgcagctccctcgctctcctggtctctggcactatccacaaaccatcacggagtaaggagtcattgtttccctcctgcctatatatagacatggtctctgtattaaccggattactgaccaaaatgagcctatgccgggacaagaaggctatcaagccacaagagaggtgctctgaagtgaactcataagagctggatggcactgacagaaaactctggcttctttggctgaccagggttcagcgtgcatttctaggtacccaattacatccattggatgcatcttttggagcgaaagttattgccttattaagcaaacctaggatttctttttttttttttttttttgagacaga

SEQ ID NO: 393160 - DNA, 300 bp, Homo sapiens
tgcttattagtgccaggatgttataaaaatcatattatttatcaccactcactcccattttgttgatagtgatactgagctcacagaggttacataatgcccagagttacaaaaccagccagcaacactgctcctccaacagaaaagctcttttgactacaccattctgccctccaaagacccctcaataaatgcaaactaattgtaagtcttttttttcccaccaaatttcttagattaaaattaggagagttgtaatgaaatattcttaacttgtggataaaggggaaaggtcctggg

SEQ ID NO: 393161 - DNA, 562 bp, Homo sapiens
tagttaccctttttttgtttctgtgccaagagcagctaatgtctactcacttagcatggggattcacatacattttaaataacaaaacacagacagatattctctcatattcacaggtgaaataaggtaactgaatggtaacttagctgacccatgactgcaggtcaggagaaatatgcggaggccttagaaaagtaatcatctaaagatgatgtgctctaatccctcatcccccaagatgaggaaactcagatccgcagtggttgcaacattcagttaacaggggaaaagctagttagtaggaaagccagaacccaaacccaggcatgcataacaaggcctagttcaatgaagagagcattatccaaaatcaaacggaatgaccacggaattctcctaagggtctacttcctgcacccatgtgcacctgggcttctctgccaggctttgtggtcatgcgccctcagacacaggtgtcacctgatatcttctgcttcaatatattcaacactttgagcaggtggacatgactctcagcttgagactaagttgtgtcaatgat

SEQ ID NO: 393162 - DNA, 291 bp, Homo sapiens
tggcctcccaaagtgttgggattacaggcatgagccactgtgcccagctggcttcttagttttctttccatttctgttgtctacttcaatcacagtatcactgtggaatgttgacagcattgtcaccttcttggggtaagtgctgcagttgcaagcatcactggcgagtattctcagggcaaacaggaaaagggttaaagtaagaatcagagattaagagggacgtgtaatgatgaaaaatataacagttctaaatttgtatgcatctaataacagcctcaaaatacataa

SEQ ID NO: 393163 - DNA, 183 bp, Homo sapiens
gaggcagagtttgcagtgagccatgatcgtgccactgcactccagcctgggcaacagagtgagatcctgtcttaaaacaaacaaaaaaaacaaacttgttttcatttagactcttcctggcgttggggacctattggaataggtttagtgtgaactgagagctagaagtgttagaggagagag

SEQ ID NO: 393164 - DNA, 748 bp, Homo sapiens
tgtcaccaaggggccagagcttccgcgttggttacggagtgactgcaagtgccatcgggctgtgcttcccccctgctggagggatggtctggaatctgaatgctccctgctttaacttaattctctaaagctgggctttttctaagttgtaagtctgctggaaaagatgttgttggagctggctgtgagatgtccattgtgttcattgggaagaaatatagaaaggaatcacccggctcaaatcatatttcctaagggcctccaagtcaatagtccatgaaagtctgaactcttcgctttatttttaattaattcactttaacagttttactcattcattcactcacaattacttttttttctcataactaacagctaaagtaagaaaatggctaaattaaactatgtctggttttataaaacacgatttccctttttgcattttaggaacgggcactacaagtgcctttagtttgttctttaaagttcccagttccattactccaaaggttaagagatctgcctgccccgaaacacactcaattccctattattattgtctttggcaaccagcatcagagattaacactgtacatgccacctctgcacaaaagcaaaagcgtaagtccacgacagtgactctttgttattaattgttattgttattgttttggggagatccacattatcttgtcttcaagttaaaaacagtaattacgctgttcctgctgacaatgtcagtgatgag

SEQ ID NO: 393165 - DNA, 390 bp, Homo sapiens
gaagaatgattctttggctaccaaaaactatttagtttattttctaagagacttgcattaatatgtttgcagaaaaattaaaccagaacacctgacttctttatttcccaggagttttcctccacacctgcccccatcaggggagaaaattgatcaggaggtaccacccctttccacaccattcttgaatctattctacagaactctctcacatggtctagcaatatgtttaaggtagaaccctttttctatcaatatttcttatgtgttaaatttgcattattatatgttgactagaaattatatattccttcttaaacattaatcataatgaatctaaaaacctaatttatttcaaccaataaatttctctttaattcctgtcctcaa

SEQ ID NO: 393166 - DNA, 724 bp, Homo sapiens
catttgtagagtgcaggcagagtagatttagcataattcttaaggaccctaggatttttggaatgctaaatgagcattggcttcatcttaaagtcaccagctgcaattagctctgaagagtcagccttcctttaaagccagatactgacctcctatgaaagtacttgatggcatcttctggtatgaggctgtttcctctacattggaaatatggtattttgtgtagccatcttcattcatcagtgatattagctagatcttctggataacttactgcagctctacattcgcacttgtaccttcagcttgtacttttatgttctggaggtgacttctttcggtcaacctcatgaatcaacctctcctagcttcaaatttttcttatgcagcttccttacttctctcagccttcactgaattgaagagaattaaggccttgctctggattaggctttgatttaaaggaatgttgtggctggcctcagcttctattcagaccacataaagttttctccatatcatcaataagtctgttttgctttcttatcatttgtgtgttcactggggtagcacttttaatttccttcaagagctctttctttgcacttacgacattgctgtttggtacaagaggcccagctttagcttgtcttggctttcgacatgccttcctcactaagtttaattatttctagcttttgtaagtaagagacatgtaactcat

SEQ ID NO: 393167 - DNA, 572 bp, Homo sapiens
  misc_feature (35)..(35): n is a, c, g, or t
gcacttggggtggccaaggtgggtgggtcccttgntgcccaggagttcaggaccagcctaggcaacatagcaagacctagtctctgcaaacaaacaaacaaacaaaaaacccaaccaaccaaccaaacaacaaaaacaacaaaaattaaagattagccaggcatggtaaaatgcacctgcagtcccagctagttgggaggctgacacaagaggatcacttgagcccaggagttttgagcttgcagtgagccgagatcgcgccactgcactccagcctgggcgacagagcgagactctgtctcaaataaataaataaataaattaattaattaaaaagtcatccttttcagttctcaaatggcagaggtctgcatcctgccttgcgaacctattaacactcctttctttctttatgtggggtttcccttgggcctctgtggtcaggctattgtttgtctgagtttgtaataagcgtgtaacagcctccaatttgcctcaaagacaagtggtgttagttggttactagggacaggagacctttggaaattgtgattggaagctaactgttccag

SEQ ID NO: 393168 - DNA, 450 bp, Homo sapiens
actttggaacggaggaggcctttagaagaaagaaggaagttttagatcatgcctgcaattcagccttgcagagttgtttgcctgtttgaattttctcttatctctatggaacattgactacttcctcagaagcttatacactgttagagtactgggtaaaatttcatttgaaactacgggaactcctttgctgacctattgtggctgttcctaatgtttcttggcttcatgctgcttaggaccccatgggaaatcttggcagaacaccctgttatacatctatactgagtgcctctcacagcttcccttcacatcagatttttctgtttgtcacccgcttttgccccttttccttcttgtcttaaagagagacatccttcactcctgtctctgaggctacctgtctcctgtgttcttgatcccacgttgtcccttgggacactgcttcat

SEQ ID NO: 393169 - DNA, 239 bp, Homo sapiens
tggggtggatacattccaggcaggaggaacaacttgagcaagtcaagaaggcatcctacaacctagcagttgggagcaggaggttagttgtggatatggcaggtaaggtgagggatgaggctggagaattgataccaggagggcctggtgtggagcttccagaagttggaccttactctgtagcagtgtggacccctggagagttttagaaggatccccctggggattagagtgagact

SEQ ID NO: 393170 - DNA, 380 bp, Homo sapiens
caagcttgtaggaaaacagcttctgaatgaacatcttgttctctgactagcaagaagtatttctaccaagacatacaactggttatgatgtcttcccagtggaccctgccccctatagtgaggggctctggtaatgctgcattttcatttatcctcagtgatttgtcatttgcaaacaggcaggttcatgcgcctccatcctctcctttaggcaatgggtgagagaaaggtggttttaagcatcaaaaacttaagtgtgttaagaccacctccaataaaaggcatgaccctgggcttcaacacctaatttggaaaagatcatgaatcagacgatcttgtttgcaaacctattttgtgattacttttcacattctgtttta

SEQ ID NO: 393171 - DNA, 311 bp, Homo sapiens
tcccagggacttgtggacggtcatctgtctacaccgagccccagactgggcagctggctgttgcagggagtttgaagacctgcaggaaacccttgcctttgaataaggtacacagagagaaaatgtcctctcttccaaatacgtcttgccaaaatgcagggcaaccttgcctctctttctccagtgagggcctcgtgtactacagacttgggtttctaaatacctgacctagagtttcagatcctcactcaccgtccaacagaaacgtaacgtgagccacaggggtaccactaaattttctagatgctcag

SEQ ID NO: 393172 - DNA, 364 bp, Homo sapiens
tgctgggattacaggcgtgagccaccatggccagccctagatttttgtttttaatttttaaaaatattggagtgcacagagtatatctggcttcaatcatctcttttcattcatgttgctgtttgactgaaatcctctttctcctggcggatgggattggcgggtggtcctattttctaaagggaggaggcatttcctatttaatcttgaggatacagggaagatggtatagagttaagcatcaacccacttctctgtctcttctttttgcctcttctttctgcttcattggcacaaaatactgtttccattaagatgcttaaaagtgatgcaggtgcagttctgcaaatttagaaaataatca

SEQ ID NO: 393173 - DNA, 406 bp, Homo sapiens
gcacgagagattttcttgagagtgaatcattgtcaggtgacttaacctttgtcatctcgtttttttctttttgtttttgaggtagggtcttactatgtcacccaggctggagtgcagtggcgcgatcatggctctctgcaactttgacctcccgggctcaagcgatcctcctacctcagcctcccaaatagctgggatgagaggcacacaccaccacggttatctcatatgttttattacttttttgtagagatggagtctcactatgttagccagactggtctcgaacttctgggctccagtgaacctcctgtctcagagtcccaaagtgctgagattgcaggtgtgagccgccacgcccagcctatcttgttcttaatttaaaaagaacagttaagtttttgta

SEQ ID NO: 393174 - DNA, 334 bp, Homo sapiens
aataagccctgtatcacctccgtggcttttatctgtcatccatgcccaataataatagacattactggtagaaaggttgtgtattacatttacattttatttttgtaatttcaaattattttagaatagaaaatatattgtgagagcacctaaaatgctcaagaatgttgcttctactaccctctctggaattgtgtgtaagtatttctactccattagtagaatcctgtatctggatttatggaagttcatgatacaaaatcagcacagattggaaggaatttttttctttcaggctggctcatttcacttaattctgaagatgaacatccaa

SEQ ID NO: 393175 - DNA, 271 bp, Homo sapiens
tttacatttaaatcatgaaagaaacaccattctctagaatctttttctagaatttcatgtactttataactgatagacactgttaaatctttgtttcaatggatttttaaaaatcatctccttctgtatttgtttaaaatataccaaggtacaatattttattttcctctgcacagctttctacttttttaagagatggaggatatcttagaaactttgtaatctactttattttataggtgaaggaagtggtttattttaatgtagtata

SEQ ID NO: 393176 - DNA, 397 bp, Homo sapiens
cacgagccaccgtgctcagcctgtttgtttgttttttgtaacaaagtctcgctctattgcccaggctggagtgcagtgggctatctcagctcactgtaacctctgcctcctgcgttcaagtgattctcatccctcagcctcctgagtagctgggattacaggtgcacaccaccacacctggttaatttttgtatttttagtagggacggggtttcaccatgttgaccaggctggtgttgaactcctgacctcaagtgatccgtccacctctgcctcccaaagtgctgagaacaggcgagagccacagcacctggccagacatagggttttataagagcaccaatgtgagacagtggtcagggaaggctttccagaaaagatgacacctaaactgatc

SEQ ID NO: 393177 - DNA, 264 bp, Homo sapiens
gctgttgacagaaaacctgagtaggtaatttatgatgaacagaaatttattcgctcacagttctggaggctgggaagtctaaaatcaaggcgccagcatctggtgagggcctttttgctgcatcatcacatggtgaaaagcgagacagtaagagaatgagagaaagcacgaaggggccgaactcatgcttttataacagcaccaatcccacccatgagagtggagtccctgtagcctaattatctcttaaagatcccactgctt

SEQ ID NO: 393178 - DNA, 268 bp, Homo sapiens
gggcacaggtcggggttgctgggagggactcttctgggccagctgcctccatgcagcacagcttcctcgaggccagtctcctccctcatcacccttcaggccagcactggctcaaggtgtagctgccctcctcggggccgctcatgtccagggctgcagagcaagtgatcccgtgcattcacttgcaaagagcccctcagccctgagctgcctcggaagcccacggtaaggggtcaccagcagcactcttcccaggccctaagtcatg

SEQ ID NO: 393179 - DNA, 236 bp, Homo sapiens
atggatttttgattttgtcatctcttcaaaccccaccttccttgtatcatcacaatggtgataaggtttcaacataagaattttgtggggatacaaacatgcagacctagcaggtaggatttaactttcctaatattttgaactcagcatggccacatgactaactttagcctgtgaaatgcaaggagatgtgtgtcattgctaggcagaagcttgcagcaccattgcatgctttg

SEQ ID NO: 393180 - DNA, 288 bp, Homo sapiens
agcaccacttgcccatcttgctcctgagaccaaatggcttcttcacagaagaggcagccggcatggaatcaacctcaaccaccatctgcttttaacagccaggagaagccagtagtagccaacagatcgcgtctaccaaccagtttcaccaactagcaggtaactccgggtttccaatctgtttgaagagaaaagtcaatcccagccaaaacctgccaaccccagcaggggattccagcccagcccaccccacccagggaaaacccacacccacccgaggaaagccca

SEQ ID NO: 393181 - DNA, 308 bp, Homo sapiens
gtcttaacagtcaacaaattgtcaatgaatacttaatacaatgcaccatgccaaaaattatgcagaaaaccaagaaatacatgaggcaggatgatgccatttttgttaaaattaacaagaaagcacacatatatgcatggccatatgtggttaaactgaaagctctacaccaagagattaataagaactaacctttggtgatgggttctgggtgactttggtatttttttttttttttttttttttttttaaaaaggggcccggggaccccccttagagctacaccgtgcaggctttgaaagcttggg

SEQ ID NO: 393182 - DNA, 442 bp, Homo sapiens
tttcctatttgctgtgaatctttggtccttatttgatataaattaccttaagcaatctttttctctttaccacttatccttggataataaggacttcttatttaatatgttataacaccttcagcaaacattaaaaagtcttgagaataatgcaagaaattatcatttgcccaaatacatagcataatgaattatgtgagaaattagaatcactggggaagggcttcatagaagagatattgtttaagatgggccttgaaagatgagttggatcttgatagagaagaataacagggcgttttcagaggtacagtgtagaccatggtgttaaccagcgagtgaccactgaacgttaagggaggtagtgaagagactagtctatttagagagactagagtaatggaagataaagttggaaagtaaaggcagagccaaattaaag

SEQ ID NO: 393183 - DNA, 388 bp, Homo sapiens
aggaccagagtagtgcagtgactttgccaaggtcacacagcaggaggctgggcccagcacaccctagaccttcctctgcttcccttgccccacttggaggcacaggccgatggggcatctgggagcccacaccctccctgcccaccaggtgtctcctgggccagtggcttcgtgtcctgggcacgtgtcctgtgcacagcccggtgggggcagctggaggggtctccaaggcggcggcttcctgtctcagagcaggatcccccggcatgtgctccagcaggcaggctttgtagtgggattactaatggggcagatcaaaaggatgttcctatttcactcaaggaaataaaatgtgcacgcagccgcctttctcacgctgaactcaagt

SEQ ID NO: 393184 - DNA, 243 bp, Homo sapiens
gtcctgagagggcagggcaggtaggggagaagcggttgggttctgggcctgctgggcagtggagccagctgggttggccatcagggttctgtcgtgaacagaggaggacaggctggacacctggaaaagatggcgcgaggccctgcggaagcccctcccactggagagctctggtagtccagtgaggtcggacccatcctcgaccgacggtggatccgtctagatgtcgacgctgcagtgcat

SEQ ID NO: 393185 - DNA, 379 bp, Homo sapiens
tcaaccacctgcctcagcctccaaaagtgctgggattacaggcatgagctgctgtgcccagtcaaacatcttttctttataaattacccagcctcaggtattcctttatagcgaagcaaaaaatggactaacccacctcccttccaaggatcttgctatctatcccttcttgccctcagctactcactcccacagtcatataccagatctcatcattagacaattgtaatccctacacaatttagttccatgtatcctctctctaaccactattcctcatctttccaggtcattctctctagacccgaattccaacaacccttcaaccacactggtaccactaatctacagattacatcttctttctactataccttga

SEQ ID NO: 393186 - DNA, 561 bp, Homo sapiens
gacagagggggtggggggagctgtatacagacagacagacatggagaggtgggatcgtgttgagagagatcaggaaggtctcgatgggcaagagatgcagagaagacaagaggttccaagagcacgtgcacggagttgggtgcgatacccacgagaaagaacatcggagttactggacagggaactgaggatcttggaagctctgaccaggcaaagagggagagactgtgacctagagacagaagcacgtgagcaaatatgagaacgtgcacgagaacaagcgagaagaaccagtcacacaaaacacccatgaagaaagcaacacgactaaggacagacacaggaagtcccaggtccagcagctcagggaggaaggcagggaaggaggagaagcaccgagctgagaaatgggtaagaaggggctgccccattttgggccgcagaggagaaagggggcaaaggaggtggccagaaagggcctgacaagttcaaccggccagcagctaccaccctgaccagatccgcattccagcccggcccctcacacactcagctcccact

SEQ ID NO: 393187 - DNA, 331 bp, Homo sapiens
acatgagaagtacagactgaatctatgcaaggccagaagagcttctgagtaggggataagggtaagtttgaaagagcaggttgcatttgagctggactttgaaggatgactagaatttaaatagagacttgggtgatgagggtaacccaagggagttttagatgtaaaacttctgaggtaaagaagcacttggattatctcagaaaggatgtgcagttctggttggctcaaatatggataagctgaattgcagtaatgtgaggtcatgctcagaagatatgggttggagcctactagagttagagagtttttggggtctttttgtttgttt

SEQ ID NO: 393188 - DNA, 270 bp, Homo sapiens
ctcttgacactctccacagtgctccttcccttgaagcacgctggttggggaggcagaaggaaaagaagagcacgattttgaagatctctctgtgtcggcacacccagcaaccataaaaaagtacaaaactgaacagcaggctcttccatttattaggaaatccacttccagaggaagatactccatggcccctttcagtagctcattgtcaacaatgagcaaagagtcttaactgagctttgagttccaagaataaatttaatttgcctg

SEQ ID NO: 393189 - DNA, 413 bp, Homo sapiens
atcgtgtggacaaggaggcctagaatttggaagaacatatttccataagttatataggccaggcatgacactaataatagaaagactgattgaaattctgtttgcataatagtgagacaaacaggtaatgaagtaaacagacagggagcattctttcccctttcccacactctctcccaatgtaacctgtgaaatagtgagctagagaaattgagacgcagggcatctcaattctaaggtaaagtttagaaatgaaaacatgatgaatatatcatattctacacactgaaaggtggggttccctgtcctcttattttacctgagaatgactgtagccatgcagatagttccaaaagctggagattataggattttttttaggataaacccaataatcccaaacaaaagatact

SEQ ID NO: 393190 - DNA, 421 bp, Homo sapiens
ggatcctgcctcttaaaggcctctagggctgtacaagataggacagcttcatctacgtcctgtctgggggagggtcatacagccaggtgtcaatggcctttatcttaatggccataatggttttctgaaccattttccagggagccttgcttccaagaaattcccctacagtagcatacactgtgattatgcttccagtcacccaaaactaatagtggcatcagtttgtctcggtcaggtcctgttagttattctctgtgatgtaggtgaaaatatgctatagtagggggatgggttgtcaacttccccaaactacatctttctgctggagtcacttgggtctgcaaggccccctcatccatcaggcacaccaaccaggtagcttgggactctcctggcctctgcccacatctattcttta

SEQ ID NO: 393191 - DNA, 540 bp, Homo sapiens
tagttgcatagatacaacttacgaattatatcaaggcttttacacttataatattcattttagggtactattacattaattaaatattaatgctctaagcatattttcatagccttctctgttttaaactccactggagaatattactggaaattaaaaaatagtatggtttattatccatgtcattagtgttgcatttggatgatgaattattttggaaattaaaaaaaagatatataagtagaataatcccctctgggtctcatgtgtttctctaaatagcaattttatatttccttattatttttcctgagattattacatatcttccacagtgtctgtaaaatgctaagccacagtcttaaatattggagatactttctgatgagcttctaatgagatttttaaaaatactgtatgtggtatgaaaatgctcacgcaaatgtagtttgaaaaagactagtatttaatatgtgtaagacatatttataccttacattttaaaaagttaagacaatggagcacattgggatggatagt

SEQ ID NO: 393192 - DNA, 370 bp, Homo sapiens
acatggcaaaaccccatctctacaaacaatatgaaaaattagctaggtgtggtggtgtgtgtctgtggtcccagctacttaggaggctgaggcatgagaattgcttgaacccggaaatggaggttgcagtgggcctagattgcaacactgctctccagcctgggcaacagagcaagattgtctcaaaaagaaaaacagtattgataaatgttgaagtttactgatggtacatgtgggttctctgtattatttactcttgtttatatttgaagttttccatgatctgttaaatattaaaatgagaacttgaccagcagaaaaaagtctttaatacataacttacttttttcagcccaataccagaccagtc

SEQ ID NO: 393193 - DNA, 183 bp, Homo sapiens
atccttccgcctcagactcccgagtagcttggattatgggtgtgtgacaccatgcctagctacttaaaattaacttataaaaaacattttttttgagatggagtattgctctgttgcccacgctggagtacagtggcatgatcttggctcatcacaacctccgcctcccaggttcaagcgatt

SEQ ID NO: 393194 - DNA, 250 bp, Homo sapiens
acacatttggatttgttcaagcaggttgtacagataaaaataaggtcagtaacattctgttgggctacactggtgactctggacaagtcatttaactttgctggttgtaatgaagttagtgtaagtgattgctaagtgtcttacagcttagaaattttatgacagtccattgttttctctttgtgtcatttggtgataccagttactttgaaaatgaaaaacacgtcccctcaggcatgaagggtaccga

SEQ ID NO: 393195 - DNA, 251 bp, Homo sapiens
ctaaaagaggaaaagagaagtagagaggaaagtgggaggcaaagacaacaagagtatctccaggacacagagggagcttgacatttctacacctttcctgggggactgactcactctccatgtgaaaggaaaacaagatacaaagacataactttgcccagagaggcaaaagagagagactggaaatggaatgcaggaattctagctgcccagctcagttctattctggaatccacttcacttctctatga

SEQ ID NO: 393196 - DNA, 406 bp, Homo sapiens
ggctcatgcaagtaatataattcatttaaaaggcgtttatccaacgaaagccctcctgagacttgagccagttttcaactctctctgcacttccataggtgttcagcctcctgatacattaactatatcatagattggatctcttcagtaatcctgagttcttcaaaacaaatatgcaatttatagcatagtctttgtgcctcagtatactccgtattttaattgtacgttctatcccttttgtgtttgagaatacctatcatgtcctgaaaaatataaaatgtgacctggtttttattagctactgtaatatttcaatagttgaattgactatgaagccacaattgagaactttcatgaagtttgtcaagatactggctaagaatacacgtattgagtcgtaaat

SEQ ID NO: 393197 - DNA, 259 bp, Homo sapiens
tcatggtgtctgctgtgatacgtttgggcccagcatggagagaagcccctgcacatgagtgacaagggctctgaccatcgtgggggatctgagccttctctctcttgcccttgttttgctgcagatggtcaagtacatgaactttgtacatccagtgtggtattttgaacagttggggaaatcatttttgaataattttcttctgtgtaaccatggctttggaattacacagatgtgtcaatgtgtcgtgtggccacac

SEQ ID NO: 393198 - DNA, 197 bp, Homo sapiens
atttttagtagagatgggttttcaccatgttggccaggctggtcattatttcctttctaatggtaattaaaacattggtacacttcctctgaatgaaaccatatgaacacatacagccatcattcttgtgcactctgactcaatgatatgcgtcgctggaacttcgcttccgcatctcctcacagtcccttctgagc

SEQ ID NO: 393199 - DNA, 446 bp, Homo sapiens
ggaggtgagagctaaaaaggtgagagatgattgctgcgaacatcatccaaatgcccccagaagaaaatcatcctttacggagtgcacaccctgcaaaaagaaaaatgttaagaaaggagaacgaaggagcattgacaatatattgcttgattttacataaggctccagatacatttcatattaaacggtgtttatcactgtagcagtagatgactttctgttgtggagatgatttctttttggtgcatttagcatgcacggtgccaaagcaccctgtgccacaggccacagtgggaaaacaaacatatttgtctataatatgcgtgggtgggaagcccacacagattataggggccacggggcttctcctgcctggtggaagtcttgaatggggcaatcggaactgtgggatgaattctgggcatcttagatcattctccaaaggg

SEQ ID NO: 393200 - DNA, 534 bp, Homo sapiens
ggaaaaacctcttctaagtagatttgttaaattacacaatagccactatcatcactgtactttatttcatttcctgtcactctagatttccagtactcataaagagcccaagcctctcctagaatttgaaaaatcaagttactgtaaaataaggcctcccaaggttgccacatttaaaatcggagatttcagtattaaatatttgtaggcctttgaagcagatgaaacacggtatttttgtttcagtagtattctcaggttgcctcaaatactgaaattaaatctattccctacaccatccatcttcaaagtttgaactaatcatcagcaacttgaagatgttcagaaaaatgttaaaatgattataggtgttttagtgcatgaaggtcagtgtgatattctggaagcataaaataatgtattgaatgtttactctcttagaatatgtatgtctagagctaaagagatatgttacattcccgacattgtttcttgtgaatgtttaatttgatgaatttaaattctgagaataat

SEQ ID NO: 393201 - DNA, 570 bp, Homo sapiens
attgtacattagttcgttttcacattgctataaagaactactgagactgggtaatttataaagaaaagaggtttaatggacgcacagttccccatagctggggaggcctcaggaaacttaacaatcatgacagaaggcaaaggggaaataaggcacatcttagatggtagcaggagagagagcaaggagggaagtactatacttttaaaccaccagattttgtgagaactcactcacaatcatgagaacagcatggggaaatccatccccatgatccaatcacctcctaccagatccctcccctgacacctgaggattacaattgaacatcagatttgcatgggtacacagtgccacacactgtgtcacattgtttctgtatttcttttttctacattccctttcatactgtattcaattttttaatggaaaatgttaatttctactcaaataattgttaccatttcctctcctaaattcttggatgctttgtagtttccatcactgaatattgtcagctcttttcttatgcactgtatttttttttatcatggcaaagaaattgaaatt

SEQ ID NO: 393202 - DNA, 210 bp, Homo sapiens
aatctcagctttctgcaccttctggcttattttcaatcctatcatccattaataaaatcaaaggagtcatgtttactttgcacccatgtttttcttgatctctctttggcaagatttgatagtaatcattatactaattgctaatagtaaactgcttccccgggagttaaaaaaaagttcaggaatttctactccagtttatatagttga

SEQ ID NO: 393203 - DNA, 716 bp, Homo sapiens
ctttccctttcagtctggattgtttatgtatcagggtatgtggtgactttaaactatgggttttaattcttttagctggagtgctctacctctccctctgcctgcagcatccccagtagcatgttcccgctcccctgaatgctttggcattgtctctcctctgataacgtatgtacaaatggagactgcgtaccacccttttccccagcgaagcacacaaacagtaagcagacagacactatctaggaggctgcaactcaggaccataatattgtggcagaaagtagaaaataaaacagccagtgctgggtgcaggataatagcataataagataagtgcgagagagtcaggaggcggtaatggccctggagatggagaaattctgggaaagtagggcagtataaaagcggagacaccatctgtgggatccaggcagttgtgagtgactccgaatgacacaatatggagatctgttctacaacacaacaaatagtagtaaagtaatcatctgggcctacaattgtcagacattctttgtttgaaatgccaccttcccagccatgaataccagtgtagccatggttataaatggcaaggctataaatggcctcttcctccaaccaattcaatttgcagaaagtgagaataagaaacaatttcctccctagatggactctccactggactacagtgtgcactgcacatgccctcaagc

SEQ ID NO: 393204 - DNA, 212 bp, Homo sapiens
ttgtatctgtggcttccttgagaccaactcatttattctttccttttaaaggaatcttgaaatagaaaaaaaaaaatcttattacagtgctactcaggatggcctaaaggactgtgttataccccggctagctattaatgtactttaacttggatcttgctaacatgatttcaggtgaggtgtggacaggatctaattagttataaatctgt

SEQ ID NO: 393205 - DNA, 603 bp, Homo sapiens
agccataggagttttagccaattcagaggccttgctccctacaatttggaacattcctttggatttgaccaagtcaggaagagatgggagaaaagtgaaacaacaacaataaaaccccaagcataaacaaacaaagagttaagcaaaacaacaaatgcacaattcatatgattactgagtgttctaatggtaaggagaaattaaaagcagaaattaaaagcagctgtattccatggtatatatggaattttccaatctaccttggattttcaacgtaccttggatgcacctggatttactccacgtctttgttattgtgaatagtgctgcagtgaacatacatgtaccccaggctccagaagcagacaagcagatgaggagatgaacagaagagcagaattgcagaatgatgtggcagaaagaagagaaggagcatctgaatgccaagaggagtttggctggcagtggttggagagatcagcctctggatggcaaagctcccggggaagatcatcttcccattccatcccctttccagcttcccatccatcccattgagtgccacctccaccactcaataaaacccccacattcaccatcctc

SEQ ID NO: 393206 - DNA, 412 bp, Homo sapiens
ctttgccacccactgcagttctgaccctcaacccttgcccttgtttccaagagacaactcggcctcccaaagtgctgggattacaggcatgagccactgtgtccagcctggaaaagtttttgaaacttacttcgcaaaaaaaatttggtttgaaaatagccacatgggtaaaactacataatgagaaagctctctgtcctctagagagggaatggagaatagaagtgcttggctagcattctctggattgttgtcttttcaagaaaccaccttctgctaccttaaaaacaaaaggaggtttaacagaatgcaaatggaagtgagaatgggagacacacagatgagaagacagcagaacttggtgagtaagtgaccacccaaaccaagggaggaatcagtgatgactgagtga

SEQ ID NO: 393207 - DNA, 369 bp, Homo sapiens
gttcaggttgaatttataccacttataggtagaggtgttgaggaagatggaggggagctagatagcctaagcatataccttttcaagatatctgcttattcaaagagaaaattataaggctgcgcgcagtagctcattcctgtaatcccagcacttgggagaccaaggagggtggatcacagagtcaggagttcaagaccagtccgggcaacacagggagcccctggctctacaaaatattaaaaaattggctgagtgtggtggtgaacgcctgtgctcccagctgcttggggaggctgaggtaggaggaatgagctgtgatggtgcccctgcactatagcctgggcaacagagtgaaaccccatctca

SEQ ID NO: 393208 - DNA, 261 bp, Homo sapiens
catttcctggccactgtgctagctcacatcaagttagccttctttcttcattttttagccaaggactatgtgacatgaagttaatatttagaattcaccacggcaaccatttttaaacaccaagattatctaaactgtatggacaaactgctgaaaaagtttggaagtattccctaccctccagtctcccaaatattagtcaactcgtacccaagtttcactctcaaaatgtgtcgaagcagaaccaagcaagacttttta

SEQ ID NO: 393209 - DNA, 1349 bp, Homo sapiens
tgatactgctcatcgtgcagcataacacagaggtgctcacgtgagaaggagctcaattgaaaattggcccctgcaagctggaacatctgctgtggctcttaattgataggattttccacttgcagaaagggagagtaaaacctttgaaacctcacattctttacatggtggcgtatcgctgccagtcatgccctctttgtcaccgtggtttcagttgccctagagcataactgctttttcctcaagtgtcctcttcaagggaactcacaacaagtatgctgtgtattcctgctgtgatgtgctccttcggttctcatcagatcatcccaaatgtaaactgcacagaacttagtgaaaatctaaccacatgatggaggaacaaaccaagatatgcagaaaagtattttaagtgaccattatttccattaacaggtacacggtgataacaatgatgacagtgatgaagactccctggaatatgctccaaagtctcccacctgccccccaattcctcatttgggcagcggcacaagcacccgtgtgtttggattgaatgaccagcagcaggggtgtggcggagagaggggaaggcgctgttgtggggttagaatctcaggtgtcctgatcacacagagttctcattagggagcaaaaggaagttgtggatcgtgcactgattagccagggactcaaaactgcctcatccacgactgccctcttactgagttacttacaaaataactgagtcagcacataaagtccaagaaagatggtttcgtattttaaggcaaattccttacttggttgttaggggaaaggcctctgagtaggcctgtctacaatgaggaagaccaagagcaaacagggtatacggccaggactgtccaccttgctctctgctttcagaatgtggtttacaggcaggaagacgaggcatcagagcaggtcttgtccaacctgctcagggtgtccctctgagcttgggccttggctaaaataatagaaaagccaggaaaggaactcagccatattatcccttgaagattctggaaagcacagagttcttaggaagcactaacctggttcactgaggatagaaactgtcttccaaagagaagagaaatagaaattgccttaggtcataaaccaagagccagccctgctgtggatccccagtccacattcttggagccactggaccccaggatgcagtttagcaacaggtcctgcctcatgagttggacggtcccacagcctccctgagctcatgtgtcagggtgctggggaccttggatccatctgagccaggaagttctccttcagggccagtgcaggccgtgagactaatg

SEQ ID NO: 393210 - DNA, 334 bp, Homo sapiens
tagtgggggagctggaacaggacagggtcaggcatgaggccagggcagaggactcaggaactggatgctcaggctgcctggctggggtggttcctgagcatctgtaggcaccctagggtctgggagagcagcctgaaggtgggcgtactgtaggtccctgggcttcgtccccctgggctcctggctgcccaaggacagggcgggggtggggaccaagaagcctgggctctcccggaggtctggtggtgggatgggccgatggatgtgggagaggtagctggagcagatgacacaggcatagattctttactggctggagggaaaaccacagatt

SEQ ID NO: 393211 - DNA, 731 bp, Homo sapiens
catacagtagccactagctccagggaacaacagagcacttgaaataaaattagtacaaatggaaatatgctgcaaatgtaaaatacaccagatacgcgaggatgagtaccctcctccaaatacatatctcattattaatttttacattggttacacattgaaatggtaatattttggatatattaatctaaataaaatgtacctataatcccagctactcaggaggctgaggtggggggattgcttgaggtcaagatttcaggagctcagcctgggcaacatagactccatctctaaaaaacaaataaaaaattaatttcacctgtttatttttattttttagtgtggctataggaaatttaaaattacatacccagtttacattatatttttactggacagtgcctctctggacagtgtgtatgctttgttttacatatctattttgttttaacacaaaaattgttgctacctaagtattacacggaaggctttgagtatatatgaattatgccattatttaaaaatcccaatcgctgtcttggaacaaaatgttgctgaagttcccccaaacaattttacaatgctaggaacatattttcttgtcattgctgaactttcaaatgagagcaaatgaagtttttaagataatacattttagattgaatagttacactattgttttattgtaaacaggaaagggaaattggtacttgctatgtaacagaaaa

SEQ ID NO: 393212 - DNA, 357 bp, Homo sapiens
accatgaccagtggtgttggtgaatcctgaccatgaccaactagagggaaaagctcaaagtgtaactgtttgaatcaatccatccaagtacttgaactgttagaatctaaatggtaaggccaggacagatcaactgataatcaataagctgaaggtgtttatgaagcccctgccattacatggaaagaattgtagaggatataaaaaatgatgagatatggtccttaaccagaaggtgcccacgatttagctgagaaggtgagaggagctcctacaaagctcactgaccacaggggtgatgtgtgatcatgtcaatccaaacagcagacacgaaagctcagaggaaataaaggcacc

SEQ ID NO: 393213 - DNA, 550 bp, Homo sapiens
  misc_feature (3)..(3): n is a, c, g, or t
  misc_feature (174)..(174): n is a, c, g, or t
atngcagggataatactgaaagattatggatttaatcctacatgtatgtacctgctctgagccaggtttatgcccatatttctgggcatctaatcttacttaactctcccaataactctatgaaatatatattagtttttggaaataagttgaagtttactgaggcacttcccntgttcccctgtggcttggtatggtgcctagaacatgatagacactgcttgatggcagtgtttggcgttctgattctaacaccactcttctggttattacatcatgccagcttcctagaagatatcaggatacatatgctttatgttgtatttagggttaagtaaatgtgagtcagtttaattctgcatattataactggcaagtactgaaccatggtaccaaagtcaacggccatgtaaaaaccattttcttattcttctagaccattgttttagagctacagtaattcttagcaaacttgcttttaatcaacttatttcctgtgcttttagcctttgaaaaaatagttatcttagccaatttgtagggtgtaagg

SEQ ID NO: 393214 - DNA, 368 bp, Homo sapiens
gggctgagcttggggaaaatggcagcatgttgtagctattgggggacccggcagggagactgctgggtcagctagccacctctgtggtcctccttgcatggtcctcctcaatgctcctttctgatgtacagcttgagataagaagtccctggaaccagatgcagacccagcaggcagaatgctctgcagaagagagctaagcttcagccccagagggaattaagtaaggggattggggagggagagtgtatgcttcctgacctccacttgaaagcattgttcttttcctaagggaaaacagcccccagcagagctcactgggacatgcaacccctcccttttccttccccatgcgtgtattgccagtt

SEQ ID NO: 393215 - DNA, 347 bp, Homo sapiens
cagttccagctcagggacaggcccttcctgaagaagatgctggaggagcagagggaagaaggggaaaggagagcttctctttaggtgtgagtctccctcagatggcatggcactttctgagagtaactgccgcactcttgagtctggcgtatagcaaggaagaagcagctgggtggagccagctggagtaaaagatttagcaaaacctctggtggtgagggtttggcatttttaaaccaccatttattgagcaggctttgtgctaagttctttagagcaaaatcccttttatgctcatgatggtggtagaaagtgagagctatcatttcctttttataaatgagact

SEQ ID NO: 393216 - DNA, 256 bp, Homo sapiens
cacatctacccatattgctgtctcaggaagcccctccgcttggccagaatggagcagccgaagggagttgattggacagtcatcatcctgacctgccagtacaaggacagtgtccaggtctttcagagaggtaggggactccccttcccaccttgcccctaatggagaacctccctccccttcctggctatgtccctccaacaccaggtgccaggccaacctgggttcaaacccagattgcacttctccctagcca

SEQ ID NO: 393217 - DNA, 564 bp, Homo sapiens
ggcacctactactagcctccccaaaccatttttagaaacttgggaacagttaggacttacattttaaattaaaagaaacagtgtgacgtgctttctttggaagtttaatatagtttctatacatcagcaatgaaggaaaaaactagaaagtgtaacttaaatgctaccatttacaatagtatcataagaccaagtaagtgcctgggaatacatttaatatgtaatatgttcaaggcctctaaaaagaaaagtagaaaacttcattaaaaacaagcaattggctgggcacgggtggctcacgcctgtaatcccagcactctgggaggctacggtgggcggatcacctgaggtcaggagttggagaccaggctggccaacatggtgaaaccccatctccaccaaaaataaaaaattagctgggagtgatggcatgcgcctgtaattccagctatacttgggaggctgaggcaggagaatcgcttgaacctgggaggtggaggttgcagtgagcagggataatgccattgcactctagtgtgggagacaagagtgaaactccgtctc

SEQ ID NO: 393218 - DNA, 200 bp, Homo sapiens
cacttacatttctacataccattgttcatttttatttcctcttaaatgagcatctcttatattctggatgcaagtggcgccaacttcaaaaaaaaatgtaacatctgccttgcattccagctcagtgtatacagtgggagtctacttttcctgctctgtttcacgagatcttagttttgaatccctgctttgggatagta

SEQ ID NO: 393219 - DNA, 305 bp, Homo sapiens
atcacttgaacccaggaagcagaggttgtgttgagccgagactgcgccattgcactccagcctgggcaataagagcaaaactctgtttcaaaaaaataaataaaaataaaaaccactatgggttaactttcagcaagtgcaaactaaaaagtaaagcacttcttattagtctgaaaaaaatacagttgaatacaatttcaaaagtatagttttgaatataaatgtactttgttttttaaactaagctttccatttccccagcctacaaaagagagcaatttaaaatctacatccacctgaggcct

SEQ ID NO: 393220 - DNA, 501 bp, Homo sapiens
tgccatctattgaggtgacattacattgtgtttttatctcgtcttaattcatgacattaaattattctactaacagtaataatgctgtaataaacatcattatagattttgcttttttatatcttgtttgctttttcatatttccttagaatttacttgaaaaaattgaattactgggtaaagggcttttgcaaagtattgttaaattcctcgagttgcatttttggaaaggggacgtgaatattttatcaactaatttggtctccctgctgccattagtgactgaatatcttaatctgaatctcagagtgtagtgggtttttagtagtgctgaagacaagttttctaaagtgtattatggtgataaattatattttaaaaactgtcaatggcttgaagcacaatagcctaataactaacgaaaatacatacaagatagaaagtgggtagtatttcttgtacttgcatttcagatctaaatattttaacatatttaaattt

SEQ ID NO: 393221 - DNA, 624 bp, Homo sapiens
attcagagggggggttttccttgtcatttagtttttgcagcacacacactccatatttaatccactatctgcctacaacctagtacttagctattattcacattctcatgtgggcatatacccaacttcttactccatcaaacactggaataaacgttaatatattaggaaattagaaaaacgaaatgaacaggagggaaagcaagtacattttcacacaaagtacaggatacagctgtgatctgtcaagcttacaagactgtctccttagctaacagcaaagctacaggactatcttctcagctgaacaggaagtcgcagtctaaaaaacataaatgttcccaagcctcaactctattcccttcacttcacatttctagcatgcattaaccctttgaccaagcctgtgtaatacacccattcaagtagccttgacgaggtgtcagcaagtctatggatgacaagtactttgagagtccacagaataacctttcatcatgatgtccctaaataaaaagccatgtgggactaatgtgtttggttgtactcttcagaataaacaggttgtagcaagaaagacaaaaccaactttggcctttgagaaattcatacttgtatgaatga

SEQ ID NO: 393222 - DNA, 302 bp, Homo sapiens
tccttgtaatcctagcactttaggaggctgaggcaggtggattgcttgagtcgagtgcaagaccagcctgggcaacacagtgagactctttctataaaaaattttaaaagtcagctggatgtagtggctcaccctctagtcccagctactcaggaggctgatgtgggagcgtcgcttgagctgggaagatggaggctgcagtgagccatgattgcaccactgccctccagactaggtgacagagtgagaccctgtctcaaaaaacaagcaaacaaaaatcaatctgttagcaatgagaacta

SEQ ID NO: 393223 - DNA, 252 bp, Homo sapiens
ttaaacgctgcttactcctaacattgtgccccagagggcagggcaacagcacagctgctttcagggaattcggaacttggagaaggccgggcatggtggctcacactagtaatctcagcactttgggatgccaaggcaggcggatcacttgaggtcaggagttcgagaccagtctggccagcatggtgaaaccccgtctctactaaaaatacaaaaattagctgggtgcatgcctgtaatcccagctacttg

SEQ ID NO: 393224 - DNA, 260 bp, Homo sapiens
gatgggattggtttagttaattaacaatatctgaaaacccctcatagaatgaatggcaagtcccctatggagataaataaggtggttgtggcccgtaagtcaaatgatgctttcctaggggaagttccatagttctctggctcccttccgtgtgtctgtgcgagcagctgtgtctcagcactgtcagtatcacatctgccttggagctggaaccatctgtggtctacccttgtgttttatcaaggtaccctgtttgcttc

SEQ ID NO: 393225 - DNA, 201 bp, Homo sapiens
ttttgctttgtactgtgtatggaacagtttggtatgaaaattaactgtagcaaaagcatagttaactttaatagcatatctggcatctcttttctcacacatcacgtctagtacagtagcaaatccttttggctctgccccttagaacaggggttagcaaattatggcccccacctctttatagttcatgagctaaaaatg

SEQ ID NO: 393226 - DNA, 181 bp, Homo sapiens
gaaggcaagggagctcctctctgagggcttcaatgtcctctgatggaagtcagtgaggtcgtctgagaatggagagaaggaaaagtcacaggtttgagtaatgggtgggaggtttgacccagtcattgtggaacatgaaagagcagattggccaaagacatacagcatgtgcaaaggccct

SEQ ID NO: 393227 - DNA, 814 bp, Homo sapiens
ccatgccacaaggctgctgtgaggatcaaataagagactagaagtgaaagcaccactgacttactcttcaataatgctatatttattgggcacctactgatcgtctggtgctagacagtgagagtataagagaagacacagtctcttccctgatggcgtttaaatctgctgctgacgcttaaaacaatttcaacatagtaggacaagtgctgggacagggaggtaccaggtgctgtggagcaggagagaggaagctaacccagttgggtaactagaggaagacacagctaagcctcaatacctgagggatgagtgggacagggctgaggcctggaagagagtgtcccagaccaaggaagggcacaggctgaggcctggaggagggacacagggccggtgggggccactggtgatcactcaggctggcaggggcacagagcacatgggaggagggatgacattagctcacaagcagtctcatcgtcatcgatgataataaatgtctccattcctaggcatacgtttatcttgttttctccattaaaataggaatgcatgtttcgtctctttgtaaaacctgtgagtgaacgagcactgatggtactgaaggtatagtaagtgtgaaggatacagatccaggaatcatcctggttcctgcaggggagatttacagagaactcatagagcagatgaggaagggttatggaggctccctagaaggactactgcagcacagagattcctgacatgcaagcatccatccaccattctgctccagaaagtgacctctgagcccacatctggaagaactgtg

SEQ ID NO: 393228 - DNA, 808 bp, Homo sapiens
gttaactgaacttgcagggatgcaattgatatataagaaatataattaaaattgcaaccagcaaatgtaaatactaaattgaaagattcttggttttttaattttaattttaattttttgtagagatggggtcttgctgtgttgcccaggctggtcttgaatccctggcctcaagttaccctctcgcctcagcctcccaaagatctgggattacaggcatgagccaccatgcctggccttatttagtattattttatgttctgtatctgtacatagatttaatctgttttcaaattagtgaaataattatcaataagatggagccaaaacatgaaaataattttaaaatgtctttatgtgacataacacagatttgtgtaaggatttgaggttaagtggaccaaagaattgtgtagtaaaacactgacaaacccagaaattaaatgcgagttttctctgtaacatgatgtgacgatgattatattattattattattcctgatagggttgttttccttttaagaagaaatgttgggtccatttaagacttaaactaaattacaatagcattaataactatggttccaaattaagagtagtctttatgctgtgaaaaaagaactattgttgataagttcgttttagaacaaaaagatatgattgttctcagtaacatcatctttgaataaatagggcagcctctgatgatgtagcctcgttttgcagtgtgcgtgggaggtgagcacagaagagacaaaagggccaggggatggtgagaaggaatagcagaagggagggacacctgggt

SEQ ID NO: 393229 - DNA, 628 bp, Homo sapiens
cctgctgaagaactggatatgtccacgatcttatagggtctccccagagattgtttattcattgcatagaaaaaaatcagtaactatacaatggataaccagacattttttgatcttgcaatcaaaattaacatctccagtgagggacagagagagagtgtgtgcccccaagatgtgattcccagggaggacacatcatttatgtagtattctatccagggatgcatagcctgtgtctaatcctgaggaaacatcagagttgaactcactgaaaatctttaaaattactggtctgtattgctcaaaatggccaatgccatgaaaactgaaaggctggcctggcgtggtggctcatgtctgtaatcccagcactttgggagcctgaggtgggaggatcgcttaaggccaggagtttcagaccaaccttggaaacataccaagacctcatctccacattaaaaaaaaaaaaacaactttttttttttttttgaaacagagtctagctttgtcacccaggctggagtacagtggtagaatctcagctcacttcaccctccaccacctcccaggctcaagcgattctgctgccacagcttcccaagtagctgagattgcaggcacccaccac

SEQ ID NO: 393230 - DNA, 440 bp, Homo sapiens
cagagttattcaacatatgtaagagtccctgactgtagaaacacctcatggaagcaaattagaaactctgaaatggctcatttgaaattctccaatcttctcttaaccaatgctggcagatttttatctgaagcccttcagagctgagaccaacgatacttccacttgcctttagttaatatcgatcaactaattcccatcacaactaatggacagctggtgaaataggctcagagtgtgatctgtcatggccagtgtggcataaaattaggaagtaggcaaatgtgcctccactcccatttccttcccattccagaatcccaacttcctggaatcttcctgccacctcttgcttcccagagccatgcctgcaggttctgccaccaaaagttagttggtacccactgtgttcttgaagagtcctattaactgatagagac

SEQ ID NO: 393231 - DNA, 867 bp, Homo sapiens
caactataacaattctaaatatattttactgtaaattattgagtacacaaaacaataacaggtaactattcagctcacctcagatttaatacttaaacattaaagaatatcaacctacttgcaagaaacttaacaaaacctaaggaacataatacaaataaaactttacctatgcagattataagctggatattataatatccaggaaaatatccaggatgttagaatggcttgaaacagaattgaaaatttttgagctataagacacataggagaaattttaagttcattttttttgggtgagacatttattagtctcaacaagactgaatgattttcttttaaggtcacacatttaaatagttaacaggagaaataccaaccagaatcatagtcaaatacccacctactccctttccaagacaactaaggtctcaaattgcgcccatttttctcaaattatttctagaatatttagcaaaagaggcttttaatttggcatatctttgtctacaattttgtagtttgtgtaaagaaaggtagattaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttcccttttttatttattttattttattttatttttttttattttagatggagccactgcactccagcctgggagacagagcaagactctgtctccaaaacaaacaaacaaacaaaaaaaccctgtagcttgggatcagccttctcttctattgtttttcttta

SEQ ID NO: 393232 - DNA, 326 bp, Homo sapiens
caatccattcggtggtgagtatcagtcacaagagtctgcatcacacactatcagcaatcaggatggctatggggcaaggacgggtttagaatgttaccaagtcacaggcctggcatgaaaaagtggaacttagtttgtggcttacccaagagattaaacatagtctagttgtatccacgcaattaagatgggaaggttaaggatcctgtattccagatcaatctgcactcacaaaacgaggaccgtagtaaacgcaaaggaatgactcaatagtagcgaaattcagacatccttgacaagccagtaggggagatatttcaggctag

SEQ ID NO: 393233 - DNA, 273 bp, Homo sapiens
tcatggcttatatctgtgtctccagcacccagctcggtgcctggtgcacggcaggccctggttaacacttgctgggatggttggtactcggagaggacttgtccccctagaatatcatcacaagcaacttcctgcccctttcctagtccagcctccctctcctggctcagcctttctgccactttttccaggaagtgtttgtagttacaaagtgttcacctgcatcatttcacttaaacctcaacaactactcctccccccctttttgtttgg

SEQ ID NO: 393234 - DNA, 379 bp, Homo sapiens
cttagtttcccatatgtaaaatgaaaggtttagaaaaatggtccctaaagttctttctagctctatatttttactatataaataaggagtcaaagagccaagcagttttttattctaagcaaggcattaaatatgatattcaacaaatattaatcaaatgcctcccacacattggcccattactaggcatgaagtatataaccttgaacaaaacaagcacatttcttgccctggtggagcttatggtctggagtttaaattaatacaagaaaatatagcagttattctacaaaatcagggacagcttccttaaggaagtatctgtgagcagatctggaggttgggtcatttaaagagagggggcaggatatagctggca

SEQ ID NO: 393235 - DNA, 609 bp, Homo sapiens
gcaagaatttgcaggagtagagctaggagctgaaaggtagagttacgatgaaaatgcactcagcagactgaaagcagaggtttgaaatcaacaagatgtaatttaataggactacatttaaaagtaatttttttaaaaaagtgcctcaagtacatgatgagaaagactgttctgatgggcacaattcctggggaaaagacctaagtgctttggctgcatataggatgagtgcaacactgaaatggctgagacagagacaacggtgaggaacagtcctgccgttctctctgtgaatccaaccataactggaacccatatctcacctcagaaagaacattcagaaacggcaaagcgtttagagaagggagaccagaaagttgcgacacatgaagcaaagttgagcaaatgggcagcaagcctgtgcttccagcacccgaagggctactgtatgaaaggacttcacagtcacacagtaactgacggacagaaattactagaaggcaatgctcaacacaagtaagtacccaaaaataaagttgcctgtctcataaatagttctcacactgtcacttaagaaacattcaggcagccgccaaaagaccagtagga

SEQ ID NO: 393236 - DNA, 616 bp, Homo sapiens
aatattaccgacctctttttattgttgttatctatcattagtaagtgtgtgaaagtgtttttccatatcaaagtgaagtccacgaaggtcttgcctgccttaccttagttggattccactaatcacccgatcaccccggccacagctccaggcctgaaaccaaagtaccagcaggaattaaacaacctcttcaaagagcttcctaaaatcttaacctttaattggaaaatgcagatgatcaaatcaagcactgacgtgaccgggtaaaacttgaaatactggaatcctagacaaaattgttttgatgaatttcctgcagacgtgaaaacaagcgattccagtaggtcaacaagtcagaagcacgttcttggtttaatgaagctctgttaaactattttctctttttcctagaaccccgatcttttgttattgttttcagatgatgtgtgtgtttgtttgtggctggcttcacatcaccctggagggttcataaagataggccacgaagccccgtgcttgtagacacacaccccgacggacactggcctcgcgtgatgacgcgtgtgagaaacccgccccagtttgacctctgcagtacataagggtctgtgggacg

SEQ ID NO: 393237 - DNA, 276 bp, Homo sapiens
aggaaaacacattagaaattccggtaaggaaaatgtcaacaagattttcattctcaacggagctgacaatgttcgcccccaccttccctgcctggtgtcagatgaacagtaaaggacagtttgctccagagcgaggttttctctttacaatgcgttttcctgtatatgatctcatctgggattcatgacctctgtgaatggtaaacaaggtaaatcctttttcttacccttatttttatttcattttgtttgttattgtcatatataccatgcatt

SEQ ID NO: 393238 - DNA, 346 bp, Homo sapiens
aacacaaacagaactttggacaaatactacttattaagaactccctgtgtgttgggtacattatatacccttctaatacaggctcctctaaagtgtatatcattacgcctaccttctggatgaagaaatgagcatagagatgaccagaggcagttggtgagatgtgggacctgaactggactccaggtctggaaaacttggcctgtccactagactgtggtcctcccattctctccaggactatatcctctggtttgcattgcttcaaaacagcaggcttgccattagaagcaaggaacaccgatggaattagggattttctgtgaagtaagctggcatttacttc

SEQ ID NO: 393239 - DNA, 242 bp, Homo sapiens
agctcatcagctatccctcatgttaatgtattttatgtgtggccgaagacaattcttcttccagtgtggcccagggaagccaaaagattggacacccctggtccaggccacgtagccctcctgcactcacctttcaccagacacctgcaagatagctgcaagactgcagctcactgcagtcttggggttatcagtactgcacacagcactgtacagcatacagcataaacgctgtcctataa

SEQ ID NO: 393240 - DNA, 249 bp, Homo sapiens
aaaagacggggtcttgctctgatcgcccaggctggaaggcagtggcgcaatcattgctcgcttcagcctcagactcctgggttcactgcagcctcggcctcccaaagcggtgggattacaggtgtgagtcaccgcgcctggcctattttgttttggggtgtttttttgcggaggagtgctgaaggggtgttggcttgtttttaatccctgttttgcagataaagaaacgggctcacgggccgggcgcag

SEQ ID NO: 393241 - DNA, 686 bp, Homo sapiens
ccttcctccttctcagggactttgctccttctgttctcactgtgtaatcaatctttacccctttattctcaccagaaaattaagtactcagtatttcccatttttcattccttcttcataaacagtgctcaaaagagttgccgacatatacaggctccacttactcatcatcaaatttctgcctgatccattgtgatatgacttctgctccgacaaataaaaataaattgcttttgtgaagattatcgattacctccatttgccaaatccaaaggacatgtcttactgaatctcttaccttcgctgaacacaagtatccactccctatttcttgaaatactttcatttttcctcctatttctctgacggctccccctgctctatgtcctggggttcttcaaagcctggtcctagattcctttttatgttcctttatattctctccctaatgatgtcacctattcactcagccttaaataccctctacatactgacaattctttctttcaaaggcaaaatgatgttgccatactgctttatgaaagtgctttatgaatatgctgtaagaataattagaatcacagaaggaactttagagaatatcaagcctattctacttattcacagataaacatctcagaggtaagggacttgtataatgtcacagaacaagttagtgacaaacc

SEQ ID NO: 393242 - DNA, 364 bp, Homo sapiens
aacacaaaggaatggatgcctgagaatacaatggtagccttccttacatgagaggtaagaatcatcaacagcaagccaatagccaaaaaataaggggggaggcggggagttcatttctcgagtttcagtcgccttcagaagaagacatttaatgccaaggggaacctctgtttagccttattcaggaggacttctaatccttacctccccaggaaaagcctgcctacagctccaagtccaacatctggtcaaatctatctcagctgtatttgttgaattaaatgaatggggagataaatactttatcataggaaaaactaaaatatttgtgtcaaatgccagagaggaatgtgcataagacaac

SEQ ID NO: 393243 - DNA, 643 bp, Homo sapiens
atggatttaactcacaggtttgtgattctttgtgggttcccctgtgggtctgtggcacagagttgggctgaggtatgaatccgagaagtctactttgcaagacacatgttatggaaaagggtcatttatccttattgttctgcgcattcatgcatttgtaacaatgcttgttaattaaaacattgtgttgtgtctgtgaaaaacagccatcaggtgagagcaacatttagtgaaatctgaaagtagggttaacttgtagtgtgaggctatgcacaggaaaacgcatatggctctccatagaaatgtgattcaagcgaaagctgggagcctctataaacattcttgtatttgtggatctgggaattcaagaaggtttcagatgtatgcctcaggaatgtcaagagtctgctgtatatccaaatttacaaaacagataaattattgaatgactattcaggttgcaaaacgattcttcattttattaaatatttactgcacatttaccctagagaagttctttagtaaatatagtacttgatttacagaaattcagtgcgtatgactgtttctggatatatgtattgtgttaagtgggatcctttctccatagcatgaagaaattttaagataatcttttctccat

SEQ ID NO: 393244 - DNA, 336 bp, Homo sapiens
ccctcctttcccacctcccttcccatacctgtacctctcccacttgacaaaagaagagcattccttttggccatattgagtcccactatgggtcttgccccagagtgtaaaaatcttgaggctcggtgtcgtggcccacgtctttaatcccgtcactttgggagaccaaggcaggcagatcacttgaggtcaggagttcgagaccaggtgtggtggctcacgcttgtaatcccagcactttgggaggccaagacgggcggatcatgagatcaggagttcgagaccagcctggccaacatggtgaaaccccttctctactaaaaatacaaaaattag

SEQ ID NO: 393245 - DNA, 364 bp, Homo sapiens
tattttttggaattttctggctaatttgattagctagattaataacagctctatctgcaagtctctctttaggaaaaaagtgtatatgtactacataattttcagggagtacagagatctctctgacccccttaagccctggttaaaaactccaaattaaagttatatcttttatgatcgtgtgttttatatcataaaatgccttacttttaacaaaattattagtagctttactttgaggattttttacaattttgctaaacataaacgtttgcatgttagtgtttttaagatatgcagattataagacacagtcaaattaagaaacatatctattgctccatgtttttaatagctttgggta

SEQ ID NO: 393246 - DNA, 505 bp, Homo sapiens
cttctgctcatgtccagctgtctgcctactctagcagttgcacacacagtgctcaaaagtgtacatacacatcacacacacaacgcactgcacactaacacccacacagacactgtatagagccacccaatatagcccacagagatgacactcatacaacagaatatgaaccacacagagactacacacacagcatatggagtccacacaaagagcacgacctgggcagacctacacattgatcaattcagccagcagaattaattcattgtattcagttgtttatattgaacacctaacattgtagtagacactggggattcagcagtaagcaaaacagatgcaaatccctgtctgccctcaagggactcatattctaatgggtgagccaggctagaaatcagataaatacataaaatatagtgcatggcagatggcgataagggctaaggaaaaatagaaagtagagaatgggaatagggaagtccacatgagcaggagggtt

SEQ ID NO: 393247 - DNA, 268 bp, Homo sapiens
acgctctctctgtgtggggatcacacgtccaggagggctgcccctccggctttcacacatccgtacgggcccggacgctctctctggggggactggagatctcagagttcaccaccttgagcagcatgtccaagagaactttctgggataagggaatgttctagagctctgctctcaatatggtagccactctcacaatattgctgaatgttcttgagctctgcttacaatacggtagcattaatggtatgcatgtggtggtacagca

SEQ ID NO: 393248 - DNA, 676 bp, Homo sapiens
cacctgactgcaagagtagggttgtgtctgatgcgacctccattcccttggtcctgcgtagtaggacttgataaaatgtttgactgtgtgtggacgggagttggcacttcattgcttactttctaggttatcgaaagcaggctctgttgggttagtgttgccaggggtggcttcagagggagacaacagctcagctttccaacctttgttccctcagcatcccataaacctaagtggttttttttttaacgcactgtgacctggaaacttggattgtttaaccaaaatggcccgctggcctccctccaaggaacacacccagcaggtattgggtgtggattgtgaaaggtcagattctatcgctgtcaagcccagccttctgcccaagctcccgtggagacgtggcagaaccattcagggggccgccctctccatagaatatcaggcagtcatccaaagatgtttatagagtttatgataacgtgggaaagtgcctctgctccagagttaaatctaaaaagaatacagcatgattatagctctgtgaaactcgcacgtacacatacagccaaggcctgaggggaagcacatcaccagggcagcaggaattgtctttggattggattaggagggactgtgttccttttctccttctctgtcatttctacattttcta

SEQ ID NO: 393249 - DNA, 471 bp, Homo sapiens
ggaatttgggattgtcactgtgttgtggctcaggtagcttcaaacagtagaaattattttaatttaaaacatagaagtggctgtgggaaccagttagaaaaagatttttcttcccccaaaaccaaggctggggggtgtggaagcagatgcagaggtgaagatggaaaacatcagctaagcattgccctggtggtagaaaatagggaaatggttaagaaaagagcacccctaaaaggatgggatcccaaagatgggggtggggtagaaagaaaaaccttgcttcacaaggaaaacctgtctcttggctgtgtacattgtacttgggtaccctattaaaaaacaactagtgtgcatgaggtgcacatattttatttatttaattaaggaccttgggcagatactacttttggtctggtaaagaaatgcttaaatattagtcatttccaaggaagaataatttcaagagtacat

SEQ ID NO: 393250 - DNA, 250 bp, Homo sapiens
tctctccggtccgtgcctccaagatgacaaagaaaagaaggaacaatggtcgtgccaaaaagggccgcggccacgtgcagcctattcgctgcactaactgtgcccgatgcatgcccaaggacaaggccattaagaaattcgtcattcgaaacatagtggaggccgcagcagtcagggacatttctgaagcgagcatctttgatgcctatttgcttcccaagctgtatgtgaagctacattactgtgtgag

SEQ ID NO: 393251 - DNA, 275 bp, Homo sapiens
gggcagaaatggctggagagacagaaacactggacacatggctggtcagcctggttgtgtggtgtctgttacagaagagagtccagctttcctgagcaagtatatgtttagcttcatttggtagaaccacacagacctgtactaagtgtgtcaatacaacaatgccaatgcaaaacaaatatccaaaggcctctgagatgggtgaagccaagggaatctaaatctgacccaagatgtcccatctgttcccctcctgggccattccaatcccccct

SEQ ID NO: 393252 - DNA, 615 bp, Homo sapiens
gagatgactcaggctcaggtctgccctccaggggctcacagacagaaaatgaatcattaccaagatgggggacctggctcaagagggagtgtcggggcatccctggttaggacacccatgggagtccaagtgcgaaccaggaaggacccagggggctctagccagcagggccgggtgctccctgccacctcctatccccatgctggtgtgggggctgctaggctttgaacctgtgggaatggttgcagccacaaatgccagccaggactgggcagaggctggcaccccagcctggggcttccccctgtcctaggagctctctccaccttgccctcccctgctgccctgaatccagggttgggtcacagccagatgagggtcactgaggtccctccaaatcctcaggctgctctcagccctttgctgtgtgcaggaagtctgggagatgggactccagcctcctggctgttggccccttgggcttcgagggctgcctagaggaagagtctggtgctagggacaggggcaggaggaggctgggtccagcaggcagagcactgggggctgtggagaaggccctggtcgggagggggaagacctgggctctagatcagt

SEQ ID NO: 393253 - DNA, 270 bp, Homo sapiens
ggctgacttagaggactccccacggcaggtgtactcattgatattggtgttcacgtcctggagggcagagacagccctctgaaggacaggataggcactggcatcagggactgtgttctccaggattttctgcagcagcagtgggtacctggtgatcctctgcagaggaattaccagcaagaaactgaggcctgaagatccagcttgcggcaccaccgcctcaacgatgccctgagtacaacctgggggtggagtacaacctgccggtgg

SEQ ID NO: 393254 - DNA, 521 bp, Homo sapiens
agaagatgctggcttggtggggcttctgagggctctggccttcatttggctgtgagagctacacacatgttcatatacttcacttactcctctagcaaagaaaaagttctttttccaatttcctcagaaactccaggccaacgtaaaggtttcctatctaagttagtatcagaggcataagaaatggtaaatatagcaaccatgcaaataatgtgtagctagagggaaggaaaacgaagagaaggaagaaaataaaattaaaaagtaaacgacaaaataatcttggaagcttttgtgaaaagggaatcaggatacacagattaaatcccagtctgaagttttgaaatgctctttattcattggaagctatcaggaaaagctgcttttaagaaatccatcttacagcctcaaaattaggggcccagttcaattccactcagccaaacaagtaccgtatgccacaggtaagagcaccgtgctaaaatatcaacgtggttaagattctttttaaaatgtggttg

SEQ ID NO: 393255 - DNA, 177 bp, Homo sapiens
aaatggaagcagaggtcagagaacaagcaaaacaaagacaaatgaggattgggaatgaagtatatgtgggtaccaaaatgcaagtatttgtcaagaaaaagaagctctgtaaagccagaatagaatcaagactgcatagtcagcagcctattttttttttccaaataagcacctggg

SEQ ID NO: 393256 - DNA, 372 bp, Homo sapiens
tttgttgtcaaaccaaatccatatggagccggaatgggtcacagtaactggtgcccattttctccatcctgcagggttgggactccaggcagggaacccctacacacctctgttttgggaggtggggggatgaacactggtcccagggccctcaggcagctgaatgggtggccagggatcagtctccactatgagagaccacagcaggggagcagctggtctctaaggccgagcaaagccacagtgcaaagctagggtctcaaagccaacagaggccagctctgggctaggggcaggacagcaccacaggcccgggttggggaggggctgtgcacatgcagaagtgcaccccatgttcttgtctatgcaagg

SEQ ID NO: 393257 - DNA, 328 bp, Homo sapiens
ggagaatggcaggttagctgtgctcaaagtctagttccaaccaggcttcacttaaatattactgtgttatttgataatcaagcttatacataatggcatgtaaaactaccttttaagcttttttttttttttgagacggagtcttgctctgtcacccgggctggagtgcagtggcgcgacctcagctcacttcaacctccgccttacgggttcaagcaattcttctgcctcagcctcctgagtagctgggactacagacacgtgccaccacgcccggctaatttttttgtatttttaatagagacggggtttcaccatattggccagg

SEQ ID NO: 393258 - DNA, 351 bp, Homo sapiens
caccaaaactcactcactatcaccaggacagcatcaagccaggagtaacctaccctcatgacccaaacacctcccaccaggccccacctccaacatggaggattgcaattcaacatgagatctgggtaaggacaaatatccaaacaatatcgcctactgaattggaatctgcctgatcctcaggtgactcataagcacattgaaatttgagaaaagctggctcccatctataacggcacgacttcaaggagaatataatatatttagtagccattgtcatagaacccggtctaaatacttgctcttcatttgcttcattaaaagaaatagagacctcttactatgaggatt

SEQ ID NO: 393259 - DNA, 352 bp, Homo sapiens
catgcatcacacctagtccatcagtcaatcctgttggctccatcttgaaaacagatccagaatctgcccactttcctgcctccatcatttcccctgtgatccaagccccagggctcccgccgtgtcctaagcatcaaccttctcctctcatgggctgtggtctgtgtgcaatcaacataggagccagagcagtcctttgcaaaagtcaggtcacatcacaccagtcctccctctggtgaaaaccttccagtggtcccctgatatggtttggatccatgtcccacccaaatctcacgttgaaacgtaatccccagtgttggacgaggagcctggtgggaggggactggatcat

SEQ ID NO: 393260 - DNA, 221 bp, Homo sapiens
  misc_feature (39)..(39): n is a, c, g, or t
ggctacaatgacatgccaggccttatatggtctctcctnatagcccgctctacccattccttacctctccaatctcacctcttactatccaacaccttattcacttctctctgccctgctccatcctgtgatcctgcccctactttcgttcacctgttctccctttgtcctgtcactcacccctttccacttcccctggcctattcttgaagctggtttgt

SEQ ID NO: 393261 - DNA, 294 bp, Homo sapiens
cacggctggggctgcatgttccatggaactggcaggagctggggacaggcaggagcctctcccattctgagtcggggtggcagctccctgcatgccgctgcagctgcccaagccacggctgtggacccaggcatccctgtgctctcggagcctgggagcaggtgggaaccccaccctcccaggtgcagctgcagccgcccaaaccacagctgcagaccggggcctcccgctccacggagcaggctggagtcctgccccacatcccacatagctgcaccggccctaactgccact

SEQ ID NO: 393262 - DNA, 258 bp, Homo sapiens
gactggacagagtcagcactggggaaatctagggtctgtggttgccatggtctaaggctgtgatttttgtctccagaagagtcaagtctcaaataatagtagcatttatataacatcttccattcgtgaagcatcctttgtccaaaatgttctcagcacacacccaggtagcaggggcatacggaggaaacgcgggtgtacggagcaaactgtgaggcatacggaggaaacgctgtgaggcatacgcccaggtatgca

SEQ ID NO: 393263 - DNA, 623 bp, Homo sapiens
gacccactttgtgtaatacttaattgcctgtgtttttacaacacaagtcagaagttctggcgatagtggactatcacccaaaaaagattttctgagacatctcatcagagctgctcgagtaccgcgcatgaagacggtgttagctctgcagggcatgtgctaactaccagacgatgaaagaacatttcctctagtttctggataatgagcaggcacacaggtaaagatgcctttctcagggttgacgccttttgtttcctaatgattctgatgattttgttgaactagacttttaaatattaattgttacctgcatatgtttgctgttgtggtttgcagagggctcagaggaacaagcattttaattggtatcctgggactgtaataactttttattaaaagtctggaaagatagtaatcaaaaatagactctcatctctatcttctctgtgcccctggcaaatatcctcttcatcaattttgtttttattatttgccgtcaagatggttatctctaaatatcagatgcttcaatccacagtgataaccatgtgtgaattaatgcttgataagcttcaggttatcaggtggagaagtgtggttaaggcatacagaaagaaaaa

SEQ ID NO: 393264 - DNA, 532 bp, Homo sapiens
ggctgaggcaggagaatcatttgaacccggcaggcggagtctgcagtgagctgagatcatgccactgcactccaccctgggcaacagggtgagactcagtcttaaaaaaaaaaaaacaaaacacacacacagagacacacacacacacacacacacatatatagtggtgagacgggcacaggataaacattccagttccaaaaaagggaaacagaaaaaaagaaaaggagtaacaggtccccagcaagtcctgaacctatgggtcacagcacattatggtttacggcttgagaataatctgcagaataatcctttttgtcttgatgctgtgctccccaggcccactgtgttgggaggtgaccccgccttccaaacccacaggtggcagcttcactgggcaggagttgagtccccaaggccctgggtggccctgcccctggcttttggtggtcccgccccatggcagcccctggtgagggcctgcccttgaggtggttctctgcagtggccccacctctgtggcagctctgtc

SEQ ID NO: 393265 - DNA, 426 bp, Homo sapiens
actcctctggcaatgagcttcctgtggttccttaaacatcccaggcaggctgcttcttcagggatccttcggtgtagaaagcactcctagttaaattttcatgccagtcactacagtccagatctccttggagaggcctcctccaatcacctatctcaaagaacacccctctcactagccatccccttactgggtttcattttccttcccagctcttctctctgcacaatattgctatgtatttatgtgcttgtctgtctccttccagagatttgggatgattgctataacctccagatcattaaatagtgcctgggaagtggagcgctcagtaagtgtgctgggtaataactgtaaaatcagatataatgaaaaaaagttatttggttttaaagagataaataagaaggttgggcacggtggctc

SEQ ID NO: 393266 - DNA, 188 bp, Homo sapiens
tctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttcc

SEQ ID NO: 393267 - DNA, 322 bp, Homo sapiens
attttaaaggtatctcagaggtaatttttttatcatgtttataattattggcagtcagttattgttattaaacatctctaaaaacaaaaagaatccaagagtctgaagagactactgaaatgagtttcaaaaaaaagatgcttccagctttttcctcaaaatgagaaactgttttacagatttttatataattaaacaggtaataaataatgccagattttagctcacaaagcactggatttcccaaaggaaatacatttggtgcaggtaaatgaaaagcctcgttaataaatatatatttgataatctgcaggtttgaaaa

SEQ ID NO: 393268 - DNA, 331 bp, Homo sapiens
gtgtacctgaaatatttttaaaaaaataaattatcctgcttagtgtgttaaagtagacgatgttctaatataacactgaagtgcttcatgtatcccaacagtttaccttcaagtaatatttctttatatattctggataccagtcccttattcattttccttctgtaatgtctttttgctttcttgagagtgtcatttgaggcaggaaagtttttaattttgatacagtccaattttttcttttgtcatttgtgtttttgatttgtatctaagaaaccattgcctaacccaaggtcatgaagctctactcctatgttttcttctaaaaggt

SEQ ID NO: 393269 - DNA, 539 bp, Homo sapiens
tctttactatagtttataggactcttttgctgaagataattctggactatatagctgagatataaaatgtggaataaaaatatcttatttcttaccacttcatttataataaatgattaaaacagttttggcagaaaaattctacaccaggatatctaaatcacataataagccttaatggaatctttgtttcttactgacatcaatggtgctacttatgtgaaaggaaattgggatctctgtatagattccaggaaatctgaacacacacactcatttgtctttctactctgcctttgctaatccttgatattctactccccaaaggaagtctcaccataggcctgtgtagactttagttcatgcctgcgtgtgtatgtgttgtcatttttagggacatatttgcaatctaatgtgatttgagtctatgtcagtttaattgtccccatttctttttacctttgttctgtttgccctcagataactttaggagtcatcattcacctttctctttacactcttcatcttccttttttttt

SEQ ID NO: 393270 - DNA, 398 bp, Homo sapiens
gttacatttaaaactttaggggttttggataaccagcagttcaggtaagtccatgtaagtcagaagtgtgttgtggttgccaaaaatgcaatgcctgtattatatttcaacgaaagtttccttttaaaaatgtaatgcaacatagtcatacaccaatattcctagcagcatgattcacaatagccaaaaggttactcagacagtccatggacagatgaatgggtaagcgaaatatgatctagccatacaatggaatattattcggccttaaaaaggaagaaaattctggccgggcacagtggctcatacctgtaatcctagcactttgggaggccgaggcaggcggatcatgaggtcaggagttcaagaccagcctggccaacacagtgaaaccccat

SEQ ID NO: 393271 - DNA, 264 bp, Homo sapiens
ggataggggacatactattctgtaaaaggaattaaaggcgaaattgtgaatataaaaagttgatgtaaggagagattgcatgagtgtgtatgaatgtatgtcctattaaggcttcctctttatccttcaaacagttaagatttgtaatttggggaattaacatttataagagtaattttttcttcaggttgtaaggcattaatatagttgcatgttactaattaaatgtattaacacatttcagggagtatgtgtgcataactg

SEQ ID NO: 393272 - DNA, 438 bp, Homo sapiens
catggatactaatcttaagggtaaacaaaggttgtcaagctatcaagactgttttaataatgatgattccaaagtaaaaaagtaacaatagtattttacatttatgtagtgtattagtctattctcacactacttataaagaactacctgaaactggccaggcacggtggctcacgcctgtaatcccagcactttgggaggccgagatgtgcggatcactaggtcaggagatcgagaccatcctggctaacatggtgaaaccccgtctctactaaaaaatacaaaaaatgagccgggtgtggtggcgggcgcctgtagtcccagctactcgggaggctgaggcaggagaatggcgggaacccgggaggaggagcttgcagtgagccgagatcgcgccactgcactccagcctgggcgacagagtgagactgtgtctca

SEQ ID NO: 393273 - DNA, 343 bp, Homo sapiens
gtctatacaattctgtaatcattaaaattgagaaacactgaaggaaaaaaagaatgttcaagatgaatgttccaagttttaacctagacaaattttataagttcaaaataggagctacaataaaagagtgaaagaccttaacacatcactttcatacttggaaatattaggcaaactttaatgagaaacaaggtggctccttgttaacaggcaatctacaaagacgtaaagcaacttgtccagtcgccaagtgggagctcatcagaggagtcaagaataattatagaactgctgctgtctcaatccagttctgtacttaccactctgagacgtgatataacag

SEQ ID NO: 393274 - DNA, 374 bp, Homo sapiens
ctttggtatgcaagtgtactggaatattcccctgcatctagctcaggtgggcagggccaaggcctctgcgacatcactttgctctaccccaagacaggagtcgaagtctcagcctcaagctcagggatatggtccaaagaggtggcaatttagcttgaagtccctgagcaagagtaaaagccaggaggaacccaggcctgaataagcgcactgccccagggttccccaaggggagaggagctatagttctccaggtgcaaagatcaccctcagagctcacacctgaggtaaagggcatgcaccaggaggagcagggtttttgcccataggggtggcccaggccagatactgccccagacactttgcatccagag

SEQ ID NO: 393275 - DNA, 290 bp, Homo sapiens
ttgtgccactgcactccagcctgggttacagggcaagacctcctctcaaagaaagtatgcttcaagttctagaatattctagaatacaaatggtacaccaacagaattaaattactgtattaattaaattgtgacaccggtaacgaaagcagtgctcatcataatcccaaaacacacaatcctaaatgttgaaatccaaaatatcaaaatcccggaagtctaaaatcctgaaaatcaatcttgaaatgtcaaaatcctgacagtcgaattctggggaaaggtttagcaca

SEQ ID NO: 393276 - DNA, 194 bp, Homo sapiens
tcaaacgatagggctattattcctaatcctatcaagtcttaatccctttacccagatcccattgttcttcacattgtgctgttctcaaaatattcagctttaaacttttccaaacataaacctgttctgtgatcagatcagtgactttgtcctttgattcttctcccttcatatcaaacctacgtgtgcatgac

SEQ ID NO: 393277 - DNA, 1324 bp, Homo sapiens
agcccagagagccagcccagccctgccgaccgcagcactctcggaagggctcggccacccggagcctcgtcacgagtcttacccagggttcggagcgggcctgcaagaaggggcaggccaggctggggctgcaaggcagggtcttcccttggagaagggacctgactctattattaagagaacgaaagaggcacttgccctacagtgtgtagagcatggcctctctcctggaatggcatcttatacatataacccattggagccaagagttttacctttacatgcaactacattttcagagattgatttgacttcctcttcagatgttttttctattcaagaggtaaaacatagggatatttggactctcagaacagcggtctggattttcctctttgacctttgcttacatggggttcctcagaaagcagagtctcagataaaatatatatgctatatcttttgaagaacgcagttccagggaagcaggagaaaagaaaaggagaatgagtcagacaagcaaggaaagcgaccggaattgtgccccaaagagctggcggctgcgtggtaggacatgcatactgtgtttaagctcccatttcacctttcattttctgaaagacctgtgaactgccgcatctcacaggggaagaacccacagaacattaacatctccatttccaggctgcagaggtaccaagccagtggatcctcccgcccccatgtctctcacaaagctgcttgtagcccagtggggaccagcaggcgtccaaggaccctggggagccgtggtggcagctaggctgtgtctcctgcaggcctctctgaaactgcctggctggctcatgccctctcattctgtccagtcattgacggtggctacactgcattgatctgggaacacaatgtcatttcttccctgacggcgaagagacaaatccagcaagccacagagcccctgtcacggagtggaaagcgatggtctctgaagagaatcaacaaggggagttaaaaaaagcagaaccaggctgggcacggtagctcacacctgtaatcccagcactttgagaggtcgaggtgggcggatctcctgtgctccaaagtttgggaccagactgggcaacacagggagaccccatctctactaaaaataataaaaaatacattcgtgggacatagtgcatgcctgtggtcccagctactcaggagcctgagatgggaggatcgcttgagcccaggaggtcggggcttcagtgagccatgatcatgccactgcactccagcctgggccacagagccagatcctgtcattaacaaataaata

SEQ ID NO: 393278 - DNA, 577 bp, Homo sapiens
accacacccagctaagttttgtattttttagtaaacctgaagtttcatcatgttgctcaggttcgtctcagaacgcctgggctcaagtgatccatctaccttggcctcccaaagtgctgggattacaggcgtgagccaccatgcccagccatgtaatattggttttaaatcacttttagctttatagtaagtggtgttaataactaaatgagcaaacctttaaatcttgaaatatatgtgcaaatatgagtatgtgtatatatataattagaaaatacatttgattttacaggaaaaaagaaaatatgtgatttttaaaattcattgctacatctcagtgacatccagaaagggatgtaggttctgctattatatcacttcactaatgtgtttttaaccagttactgtagttcccacagtaagcaagttaggtaatgtatacgcatatttgagtgtcagaattaggcccatttcttctctatgtcagtacaagggctatgatgactaactcttgagtatcacaattatgattcaccagcacagtttaaattggagaccctaattatatccttctcac

SEQ ID NO: 393279 - DNA, 347 bp, Homo sapiens
gtctttcactgcatctcagatactctaaaccactcaacagatgtctggagcaggcatagcaatctgggctttttcattcactgaaactatgaaagcagcatattcagtatcttataaaaaaaggcatggctaatttgcttgtaatttaagtttcacagactggttcattaatcaaactcataagagtatcttcccctcttctcttttggctttcctttacagagcaaagcctcctgtgtatgtatgagaaggactgtagcagcgttcgtagataataatccagctattgctattcaacagtagcataaatgaatgttatgtcacagggtctgttttgtgtgaaagga

SEQ ID NO: 393280 - DNA, 683 bp, Homo sapiens
gcactccagcctgggtgacagagcaaggccctgtctcagaaatatatatatataacattttaagaattatttcaacatgtaatcattataaaaattgagatattttatgttcttttaaggatattaagtctttgaaatggcttagtggctactatattgaacagtgcaactctagatctggaacagaaaattgaaaaggtatggaatcaggtgacaaggtcctggattatcatgtagagagtgaaggaagaataaaagcagaactgatgatactgatgatgcctgacaactgtaataaagagatggcaaacagacttcatatccagatccaggctcaatggcagagaatgccatgtctgattagcaatgtctgccatggtccttgaaggcatttaaaaatattcttggagactgaattaacagagacagccgacaaagagggaaattaggaggggaaagtttaagtactgagagaacacctattacaggtgaggaaactatggttgccagattttgttcaaggttatacggctgcctaccaagcattccaaagcctacactcttgtattatatagggtattatgctgctatgtttgtggtgggtaaattccaccacaggttaagtcacagaaagtggtaaaacaaaacaaaacaaaaactctaaatgtttaacaaaaactcac

SEQ ID NO: 393281 - DNA, 783 bp, Homo sapiens
tcatcctagaaaatttagaaaattttcatcatcctagaaaatttagaaaattttcatcatcctagaaaatttagaaaattttcatcatcctaaaaaaatactttgtgcccatttgcaggcaagtcctggtttcctatccccagccccaatcactaaaaaactttctgtctataaatttaccttttctgggcatgtaagtggaattacacattatgcgatcctttgcatctagtttcttttacttagcataatgtttttgaggttcatccatgttgtagtatgtctcattacttcattcctttttattgctaagtaataatccacattttatttaacagtaccaattaacagacatttggatttcttctagtatttaaatatagtgtttaattgtactaattgtaattgtattacagtaaatacagtacagtatttagcattatgaataatgctgctatgaagatgggtacaagtttttgtatgaacgtgtgttttcagttttcttgggtgtatatctacgagtggaattactgtcatatggtaactctgggtgtaacttttcaaggtgttgcacaactgctttccaaggtgaatttcccattttacatttccaccagagtgtatgagggttccaatttgtccacatcctcaccaacactccttatgatctgtcttattcattgtagtcattcagctggattttaagtggtatcttattacagctttcatttgcattttcctgatgactgacgatatgaagcatcttttcatgtgcttgttgac

SEQ ID NO: 393282 - DNA, 437 bp, Homo sapiens
cctgttgccttagctatttccccagactccacttactgtggtaatagttaggaatgacttcctgcttgaaataactgcatagcagcaacacagaaaggccttgctcatcagcagcaggacattaagagcaggaaaaacaatacctggcaaccaaatctctgctcaactttgagtgaaggcaaagaaggtatccttcggtcctacctcacactagcacttttcctacagatttgctggcccacacccagtcttgaaaaacacttgcaggtaaccttagcaaggcttcagctttataagtgagtgagtcagatggttattacaatatctgtgcctaaaatatggacaaagatggtgagtcaagatattgtggctgtttctggctataagaggcacaggggaaatataggttagataggtaaatactggactttttcaga

SEQ ID NO: 393283 - DNA, 196 bp, Homo sapiens
gaaaggtagagaaaacagaaggtacaacattttgtggctcacaggatatatgagtgagattatatacttctattccaaaccacaaccttcactagaacatctaaaggcttcattctagaaccttcatactgcttatcccaaaggctagcccactccccggttttcatgtaagaaatcttgtgggacaggcgttgca

SEQ ID NO: 393284 - DNA, 230 bp, Homo sapiens
cctgggcaatagtagcactgtgggtgcttggtgctgtccatatcccatgtggaattctgtgtccagttctgggagcccctttaaaagggatgctgctagcctgcaccatgtccacagaaggtgatggaggtacagaaatcatgcagcatgaggaaacttagctgtaagaaaggagacctggggaccatgtgggtgctgtgcccaccctcttgacagcatccctgttgtgg

SEQ ID NO: 393285 - DNA, 320 bp, Homo sapiens
aatgaaactgtatgtgatactaatcatggctcacccttactgaggtctcctatgtgccaagcactgtgctaagtggttctctgccgtgtcaaaatctcatgtaaacctcacagcaaccctacgaggtaagtctcgctttcctccaattttatagaggaggaaagcgaggctctgagaggtgaggtcaactgagctgacctggctagagttgtcaagtgggccgcccccctctgcccctccctgcacatgttcttgcgtacctctcacatctgcttacacttcgcgctccctcttgtgccattcccagcgtgtctgtcttg

SEQ ID NO: 393286 - DNA, 147 bp, Homo sapiens
ccgtagcttggggagttccacattaggacaagaggagcgcctctgtttaccgtcgtggctcacgcacggacttctgtgcaagcatttgccccacactcattcatcgatgatgtgctgggcactgtgtcgggatgcgggagtgaatcg

SEQ ID NO: 393287 - DNA, 419 bp, Homo sapiens
gaaggatttcaagattggaagtagatgatgtgatgcgttgtgatgattcaaaaagctcaatctgaggccgggcgtggtggctcacgcctgtaatcccagaactttgtgaggccgaggcaggtggatcatgaggtcaggagatcaagaccatcctggccaacatggtgaaaccctgtctctactaaaaatacaaaaattagccaggcgtggtggcgcatgcctataatcccagctactcagggggctgaggcaggagaattgctcgaacctgggaggcggaggttgtagtgagccgagatcgcgccactgcactccagcttgggcgacatagcaaaaattgacggtgacttggactaagctgatggtggtggatgagggagaagagtaggtgaacttgagagatatttatttagaaggtc

SEQ ID NO: 393288 - DNA, 732 bp, Homo sapiens
aaaagaatctatttcatgagattgtagaagggagtaaaggagtggaggaaaggaagtctatgagccactgggctagaggccctttcctttctgtggaaaagctcagttcttgccatctgaagacagaggtggctgactgcaataataatataaggagtcagaaaggtaccctgtctcccatttcatattgcctaagaaccagcctttccatattgcctgacagtcaaattgttaaagttgcttattttgtttaaggaagcaattttcaaagtatgttcacaccctaaaggtgttaatagaattcccaggggcccaaggattggttaagtttaagacagatttggtgaaacagtgttaaattctcttactcaattctcgcagccttttaattgtgcttgttatttttctcagaaggggatttagcatttaactcttcaaggatttttatgttttcttgggccatactttaggaatagttggcttaatgcagcacttcgaagaggacgacattttgggtgggatttcagaaagccccaccaaactgatttaaatcaataaggaactagttaggctcacgcaacaagaatgtttggcatagattgtccaggctggtacagtacctaactgatgtccaggaaccaggcttattctgtgttcctgccctggcatccatagctcatattactcacctcatggctccagggtggctgcagtgccaccagacagaatgag

SEQ ID NO: 393289 - DNA, 1057 bp, Homo sapiens
taggtaaataacttttgcctatctagtcatgggtgtgcttttaccgctatattaggttatttaattctcatagctggtaatgttaaaaatgagattaacttgatctcagagggataaaggaaagattacaagtcccccacctcctgccagtagagaaaggattggaacctagcattttcattaattgtatgattttggaaccatactctactcgggtacctgggcttctatttttctcaaggacattgaagttcagtagtttcttttgagtagacaagttttaatttcattctgtggcttttgttaaatgccagacttctgaaatagttcattttatttgtttgcctgtatttttattgttttagagggagagtttgttcactgagttcctcattcagccattccataagtcaatctccaagtgtttgtttttatatcacgtgtttttttcccccaatgacttaaattctgtcttgctgggttgtgctagagaaagagggaaaaatgctaaatggaaagagcagatggtagaaatataaggcaaaaggagatggccaattccaatatccataagagtaaaaataaacagtgactgggacactagccagaatcaagaaactttaggtcccttatccattctgaccataaagaatacctaaacctatcacttgtttctctgattctctagtccctcattgcctacttcctataccattcctctttattccatcaggagtttggagctaattaagaattcctaatttctctgtagaggaaaggaaatgggccgggtgcggtggctcacgcctgtaatcccagcactttgggaggccgaggcaggcagatcacctgaggtcaggagtttgagaccagcctgaccaacatggagaaacctcgtctctactaaaaatacaaaattagccaggtgtggtggcgcatgcctgtaatcccagctactcaggaggctgagacaggagaattgcttgaacccaggaggcagagtttgcagtgagccgagatggcgccattgcactccagcctgggcaacaagagtgaa

SEQ ID NO: 393290 - DNA, 409 bp, Homo sapiens
acttggggctaaggggataaggagagaaatgaggtaacagaagagacaggatttggggttggaattggatacttgttcataagagaatttcccggagggaggagtgtggatttggggtaggcagtggcctagagattatcgaggacccaggtgctggaaagaggacttcccattgcagagacttgtgaagaaaggagtgggcctgtgtgtgtgtctagagcaggagggatcgtggcaggaatgcctagcaagaaagggtagtgggttagtagtgacctggtggtctgggcagagagtcatctctgagaggaaagcgaattaggtgctttggagcgtagactctagactaagacagacttcgtttcaaatctggcttaaagatattggcagtcacttcacctctgtgggc

SEQ ID NO: 393291 - DNA, 375 bp, Homo sapiens
acttggggctaaggggataaggagagaaatgaggtaacagaagagacaggatttggggttggaattggatacttgttcataagagaatttaattctgagtgtgttagaatttgaatctaatttgtcagtcattccttttgatatcagagcttaatcagatgtgccatgttaaggtgatgtctttttatcacattaaaccttgacttatggatttcttgagtttaaactctacggtggatgtgcttttctgtgtctctgctaggaagagggacgctttgcatttggactccagttagtctagctgagctctttggccttggaatggggtcatcggaacagaagataagtatcataagaaaacagtgctccctcctt

SEQ ID NO: 393292 - DNA, 850 bp, Homo sapiens
aacagttctgtgttattgtcaggcctctttatggcagatcgtgcaggtcgcaagtggatcctgactgacaaagccacaggtgggttcatctttggggaaagaaggaagcagctggaggatagagtcactgtgaggctgtcattccaggcgctgcttcctgcttggatggtgggattcctctactgtgcagtccccctcactcggtcacctgatagttttagtaaccattgattccattgattatctgatttttctagtgttaaatgtttccttttcatttattagctggaattcttttttaagagacagggtcttactacattacccaggctggagtgcagtggctattcccagactacaggttcgaactgctggcctcaagtgatcctcccacctctagttgggattcttttataaagaacttgtccccattaacaatttggctatgctaagtacagttcagataggaaaagcaggagaaaaacttgatgaagatgaactttattgggatagagttctttccatcttactctaaagccccattactgtctatttccacttactgatctgcttttttcaggtgtctcactgcctagagcaaatttaattctgccctttatgtgctcttaaaaagttttagtttttttgtggtttttttcctaaatggtgctctacagattatgctgagtgaggggatgaaaagtcacgagtacatctttggaagcttccttgcctcagcgtatccctgctcagatagaagaggcagggactggatgacaggcacatgggggttcattgtactcctccctctcctggtgcctatttgacattttccatcataaaaagtttg

SEQ ID NO: 393293 - DNA, 273 bp, Homo sapiens
attttgccttgtagatcacgttttctgcagctggcttaaagtatttaaaacatttcaatatctctggaatccatagtgtttctaccttgatttatctcagggttggaaatagaaccatgatttaaaataaaggataatttagtgtctaaatctggtggctgaatccagcccctgacacccacaaatggggtttgagtggccagttgacctggctgcggactggggtcagcataggggccacggcctggattccctgccatgtgctgcatctgc

SEQ ID NO: 393294 - DNA, 411 bp, Homo sapiens
ctcccaagtagctaggattacaggcgtgcaccaccattgccagctaattttgtatttttagtagacatagggtttcaccatgttggtcaggcaagcctcaaactcctgacctcaagtgatccacccacctggcctcccaaagtgctgagattacaggcatgagccaccatgcccagctcaggttcctattttttatcttcttttgtagaacaaggctctattaaactcccaattggtatttatatgtcccaccttccagcccaaccatatcatctaataatatccgtctaaaataacaatcaactttggaggtgttttttttttaatctataaattgatgtggctctactaatgctagtatgtagccggagttgtgaatcatataaatccttcagaagtttatcatgcctg

SEQ ID NO: 393295 - DNA, 496 bp, Homo sapiens
ccgcctcttttacgaagcggctgtcatggttgatgggtgagtgtcaggccccacccagggacagggaggcccagtgccggctgtggagttacccagaccttacggtaaaaacgcatcaccctgaatgggggccaggccaggcatcggcccaagccggccctgcccagcggctggattctgactcgctgtgccttagtcacaggccagagactcttctgcttccagctgaggctgtcccctgccttccctggcggcccgggttcctggaaaagctgtgtgccagaggacgggagtttccctccaacttaagccattagaaagctcatttattgagcacttactaagtgtcagagactgtgctaggcactttacatgaatcttctcatttaatccttttaataaacttccggggcacatgctcttctaatctcccttttactgatgatgcaggcttgacagtgggaatgctaaccgcagaaagcagctcacctcactt

SEQ ID NO: 393296 - DNA, 414 bp, Homo sapiens
tttcccagagcaattgacaacagacagtcatgtaaacatacccagtttaatgatcatgtaagaagatgatgactatttcagtctgtccctttgagctggctctgcatagactggcaagacacaagcgttttgtacttgctatttctagataaagatctcactgctgtaaaagtcttgcttgaatccaagttaccatatgaaccagttggaataaaaatcctaaacaaagttccttaactagctgcttccttctgagcaggctttttgacagttagagatctgatgttttgcattaaaaaatttcagaaaatgaacagattttcagacatgctgtagtacagaatgccctcttctccagtttgttttccattgtctcccactttttttttttttttttttagctcacttggaaaa

SEQ ID NO: 393297 - DNA, 386 bp, Homo sapiens
gcattgcctcagaggaagggtgaccgaaggagagctcgagaaacggaaagagaatgagaacagagagagataaagaaaagcatacaaaatatttattgctgcatttccgtgccttctccacaatattgaggcctgaattaggtaggtagttgaaatctctctaaaagtgagtcagatattgtgtccggaattggtgggttcttgatcgcactgacttcaagaatgaagccgtggaccctcgcggtgagtgttacagctcttaaggtggcgcgtctggagtctgccccttctgatgttcagatgtgttcggagtttctttcttctggtgggttcgtggtctctctggctcaggagtgaagctgcagatcttcgcggtgagtgttaca

SEQ ID NO: 393298 - DNA, 406 bp, Homo sapiens
aagcagttcttctgcctcagcctcccaagtaactgggattacaggcacacaccaccacgcctggctaatttttgtatttttagtagagagagggtttcaccatgttggccaggctggtctcaaactcctgacctcaagtgatccaccggtcttggcctcccagagtgctggggttacaggtgtgagccaccgcgcccggcctccacttgagttcttttttttctgggttgtaataagcatccacttctagcagtgtggtctgcattagcttgaataactgaatgttactacttgttttaagaaaattttagatcactgttaacctgtaactttattttaacttgaattttcccttaacctgaagatgttataaaatgattttaaataatgagtctgtggaatcttt

SEQ ID NO: 393299 - DNA, 227 bp, Homo sapiens
cgcgagccctttgccgcccgcactgctcagcttgcagtcggcattcttcaggttccccctgaaggtttggcctcccccgtgggactctagtgggcagccactcccttggggtgtctgggacctggtggatgtgtcccagtcacatcttatggtcaagaaattgtattaggcaaaagcagtacaaaagagcctctttcgtttttcctaatttccataaagcagaaagc

SEQ ID NO: 393300 - DNA, 358 bp, Homo sapiens
acatatgtatatatagtatttatacttgtatattacagagatagagggaaaagacacctcattctcacgccttcaaccataagctctagttctcctctttttttgctttttagatgagacacagagggacacttgggggctgaaaggaaggacctccctgctagagctgcacggccaagcccttccttggtgctttctctgctatctccagctctcttgctttctcttccctggggccacatcttctgatcatgaccagtctagtggcattaccatgctgcttcatatgttgtggctcagtgagttgtctgtggagaaacttgactaatgaataatgacagagtagaaagaatgtgaa

SEQ ID NO: 393301 - DNA, 422 bp, Homo sapiens
tctcagcgctactgcatttgaagtgctttgccaagaggatcatttcccacaaactgaacaaggaccccagacgccttccattcttctagcagtgaatcttctccaaatggacttctcaatcaacccaaagtttcatcctcttcaaaaaacagagttcatgggatttatccactcactgtcagtgcagttttcccttgtcttaaaatttcagcccatatttaaatgatatttaagctaggaggaatatggaagtttccataaaataaaacagaggtctccaactcatttaatctgaatttctgtcagaaataatggttttcattatgactctttatacaaacttttatgtgtttataagtgtatataggtatataaaaatatatgtaacaaaaataaaacagtacagagtcttattctatgtg

SEQ ID NO: 393302 - DNA, 441 bp, Homo sapiens
  misc_feature (434)..(434): n is a, c, g, or t
  misc_feature (441)..(441): n is a, c, g, or t
tctcagcgctactgcatttgaagtgctttgccaagaggatcatttcccacaaactgaacaaggaccccagacgccttccattcttctagcagtgaatcttctccaaatggacttctcaatcaacccaaagtttcatcctcttcaaaaaacagagttcatgggatttatccactcactgtcagtgcagttttcccttgtcttaaaatttcagcccatatttaaatgatatttaagctaggaggaatatggaagtttccataaaataaaacagaggtctccaactcatttaatctgaatttctgtcagaaataatggttttcattatgactctttatacaaacttttatgtgtttataagtgtatataggtatataaaaatatatgtaacaaaaataaaacagtggcctcgttggcctcagcggtggagctctgcngccggan

SEQ ID NO: 393303 - DNA, 402 bp, Homo sapiens
tctcagcgctactgcatttgaagtgctttgccaagaggatcatttcccacaaactgaacaaggaccccagacgccttccattcttctagcagtgaatcttctccaaatggacttctcaatcaacccaaagtttcatcctcttcaaaaaacagagttcatgggatttatccactcactgtcagtgcagttttcccttgtcttaaaatttcagcccatatttaaatgatatttaagctaggaggaatatggaagtttccataaaataaaacagaggtctccaactcatttaatctgaatttctgtcagaaataatggttttcattatgactctttatacaaacttttatgtgtttataagtgtatataggtatataaaaatatatgtaacaaaaataaaacagt

SEQ ID NO: 393304 - DNA, 457 bp, Homo sapiens
  misc_feature (59)..(59): n is a, c, g, or t
  misc_feature (63)..(63): n is a, c, g, or t
cactacattacaaccgcacacaaaacaaaaaaaacgttgacggctaccgcttctgaagngtgntgcgcagaaacacatttcccacagactgaacaaggaccccagacgccttccattcttctagcagtgaatcttctccaaatggacttctcaatcaacccaaagtttcatcctcttcaaaaaacagagttcatgggatttatccactcactgtcagtgcagttttcccttgtcttaaaatttcagcccatatttaaatgatatttaagctaggaggaatatggaagtttccataaaataaaacagaggtctccaactcatttaatctgaatttctgtcagaaataatggttttcattatgactctttatacaaacttttatgtgtttataagtgtatataggtatataaaaatatatgtaacaaaaataaaacagtacagagtcttattctatgtg

SEQ ID NO: 393305 - DNA, 173 bp, Homo sapiens
aggcattgctgggctctggaaacacagcataaacaagaggggcaaggtccttgccttgcattggtgacgaaggtgggaagcagagataccagtcatgatccttttgcagtaatttaggcaacacatcacagtggcttagatgagggtggtcagatgggttggtttgctgatgg

SEQ ID NO: 393306 - DNA, 167 bp, Homo sapiens
ctcatgcttctcatgtaaactattaacatctgtactgatcaccttctatatttaccaatattaaagtgctatggataatgcaaaagcaagattacatagaacttgatcttcttcccatacaacactgtcctctactatgagaggagaggaattattacagcagatta

SEQ ID NO: 393307 - DNA, 267 bp, Homo sapiens
aaaaaaagaaacaaagcttattattcttactagaaggccaactagaagaaaacaaacaccttactgttaaagttaaaatgttatttgtcttctagaattaatttcttccccacttctcaggagaagtggctttgaacctatttctttagagacagggactcattctgtcacccaggctgcaaagtgcaataaagcgactgtagttcacatcagccctgacctcctgggctcaagcgatcctcctgcctcagcctcttaagtagctgg

SEQ ID NO: 393308 - DNA, 414 bp, Homo sapiens
ccaaatggaacccagccttccctactcacttttcccttggcaaccttcactagcagcaaatattaacaagtcagaaacctcagaggcacccttgactctctccttgcctaatctcccaactctcactctgagaactgttcatcttcaatgtgtcgagcctggtcctctcctttctcccctatttcctcagcccccacctgggccttctgcatctctgcagaagcactgaacgcacgggccactgcagacctgcttcctccaagccagtcttcagcactgtcacagttccaccacaacttaacaccatacccatttctaaaaatctctcaagtctccacatggctttacaaaagtctaaacctttcaatacaacataccctcattttccaaccttatttccttatcattccccaa

SEQ ID NO: 393309 - DNA, 322 bp, Homo sapiens
cccgggttcatgccattcttctgcctcaggctcctgagtagctgggactacaggtgcccgccaccatgcccagttaaatgttttttgtatttttagtagacacggggtttcatcatgttagccaagatggtcttgatctcctgacctcgtgatccgcctgcctcggcctcccagtgtgctgggattataggcgtgagccaccgcgcctggccgaacattttcatattattgaaatgatttgaaatcctgactcctaggtactgcataacttaccttatatcatcatactttatgtgactatatatagtatgtatatgtatat

SEQ ID NO: 393310 - DNA, 495 bp, Homo sapiens
tcggtaccgaatacggcaggcacaaggcatgcagagcacagatcgagcctgacgctaggcttgggagagaaccttgccttaaggtgggtcatcggctgggaagcaagggttcctagcttagggaggcaaggctaggctcttggagggaggagagtcagcccccaccctggtcagactggcccagcactgggatggggacttatagtccctgcttccttccactctgggatactgggtggagaaggacctaccccaggacaaggccctgtggctctttatggttcctactgccctctctgggaggcagctcctgggacaatctgtgaccagggccaaggatggagcaggtgctcaggtcagaccaactactgggccctcttccccactccttgagtgtctgtctctgcgcctcctccctctgcctcatcctgttcttctccctctctctggctcaccatctctgcttctgtcgccctctgtctttccctctctccc

SEQ ID NO: 393311 - DNA, 252 bp, Homo sapiens
gcacaacggaagaagaataattgtcttgggccacacataaaatacactaacactaatgatagccaataagctaaaaaatatctcataatgttttaagaaagtttacgaatttgtgttaggccacattcaaagctgtcctgggtcacatgcggcctgcaggccatgggttggacaagcttggtttagaaaaacatacatttacatacaaatattagttagcttgtatggtagaattctggatattttgtcttt

SEQ ID NO: 393312 - DNA, 302 bp, Homo sapiens
gtcagagaggaaaccactgataatatgagtattctgttccagtcttttttctatgcttaatttttcctttttagaaagttaggattagcctattttgtaacctgatatttacacttcatattataaaacaagtattttcccacattattaaaaattgcaaatgatgctgatgttgttgaaagtgatttttggaaccccttcttagaattgctttcagagccaatttatgaggtgcatttatttttgttattttttggacataacttgcttttgaccctgttcagtgttactcaacttcatca

SEQ ID NO: 393313 - DNA, 209 bp, Homo sapiens
ggtgaaacttatttagacatttctcatctgccatgagaaaagtatctaattccacaactttgaatatcttccctgtggtgtccctagctccctagactgagctctggagatacaagtatctgagagcagagaatgggctcttaagaggctcactcctgatttagagaagtagacaagtaaacagatcattgtaatctagtaggaggaag

SEQ ID NO: 393314 - DNA, 309 bp, Homo sapiens
cctaagaaagcagctccttcagacagtataaaaagaacttgcctttatttctgggggcccaacagtgctcacacccacagttcaacagtgacaggaatgcaaaagtcctttcctttgcataaacaagaaattcatgatggggttattttttccatacagagaccagctcattatttttaaaatgcatctgcctcggaaatttacacaaaataggactacaaggtgccaaagtgatgtgggtacttgcaagagaacttcacagaactatgaaacttactgaaatgagtacaagaaataaaatgctaaacg

SEQ ID NO: 393315 - DNA, 478 bp, Homo sapiens
ttagcttagaacatggagttaatctcattttatttacaacatcacaaatgactcaaaggatgcatttgtatttcctttcctacatatggagaagaggagtttttttaatagctctgccttgagctgagtatgtaaatgctctggtttctgtattcaaatactccatgttttgaagttagcaaagcccttagagagtacagctgacccttgaacaacacagtggggaggggcaccggccctgcatgcagttgaaaatctcctataacctttgattttcccacaacttaacttctaatagcctactgttgactggaagtcttaccaataacataaacagccaattaacacatattttgcatgttatgtgtattatgtgctgtattataataaagtaagctagagaaaaaaatgtaattaaaatcatgagaaaagatatttactaattcattaaatggaagtggaccatcagaaaggtctt

SEQ ID NO: 393316 - DNA, 504 bp, Homo sapiens
tagagatgatgattttgtgagtggcatcaatctgcattaatatgctttttagcagtagtgcttagaatctcaggtgtggtagtagagaaggaaggattaatgtggagcttggatgctctgggtagaggatggaaggactgaggtgtgcgtcagagttcaacatagacttaagatatcaaatggaacaacctcttctgtgaagtcccatcagtgccagtgtgaacttggattgcaggtaggggtgggaactaagagctggcaggctgaattgtgttcagcactccaaaccagaagttgatgggaggttgttttcatgcttctgaaaagtcattgctgagagtgagtgagattaatagagatgatctagtgttggtacacagaatagtttgtgaaagctggagggtagctgggaagttcctgcagagctccaggtgggtggtgagagagactggagtatggccctgctttccgcattaccagagtcgcctgctcaggatggccagt

SEQ ID NO: 393317 - DNA, 640 bp, Homo sapiens
ggtgttaaggtctcccactattattgtgtgggagtctaagtctctttgtacatctctaagaacttgttttatgaatctggttgctcctgtattgggtgcatatatatttaggatagttagctcttcttattgaattgagcactttaccattatgtaatgctcttctttgtctgttttcatctttgttggtttaaaatctgttttgtcagaaactaggattgcaacccctgcttttttctgctttccattttcttggtaaattttcctccattcctttattttgagcctaagtgtgtctttgcacatgagatgggtctcttgaatacagcatactgatggctcttgactctttatccagcttgccattctatgtctttaattgggacatttagccaatttacatttaaggttaatgttattatgtgtgaatttgatcctgtcatcatgatgctagcaaccaatatctctcatgaacatagtcacaaaatattagcaaactgaatccagaaatatttaaaaaggacatacttgggcatattctaggaaggcaaggttagttcaacatttaaagtcaatcactgaaactcttgatctcaatgtactaaaatagtacaattatataattatctcaatacatgca

SEQ ID NO: 393318 - DNA, 480 bp, Homo sapiens
aaagaatttgctgttaataaaaggtcactatgtatatcataggtaagcatgctgtttttggatgcagctatgctagtgttcactgctagttgaataatctgccagtggacacacgcttcactgacattgaatgttaaggattctcagtaatctaaacgtcaaacccgccaatattagtaacttgaagaatggatcaagacagcttatttgttgttatttcacatttataaaacgtcttaacattactatcttatacttaaatacagtttgtaaattgataacaaaatgagttaaaaattactgggaaagtccttttaagtaccaaaatgaaataaatattcttccatgcttaaatttttatgaggaatttttatttccagcaactgtaaggctgggcagcaatgtttgaagaagtttcaataaatgtaaattgaataatttttttttttggttttatagattgtcaggtgatcaaccaag

SEQ ID NO: 393319 - DNA, 442 bp, Homo sapiens
tcagtttaatctttctcccttctgctattctccagggtttgtattccttacatttgcttacttctttttccaccgagaagctcctagttccatttgtaactaaatttctcacccgagtctcttgactgccactgtatttcccaccttgtgtaattctcaccaaagattcacctaacttgatatgtatttatgatttttttctctttctaggcatcagacatatgttattcactactgcactaaaattgataatgtaaaaattttactttatgtattatttcagggcatttttataaattgcaatgactggtagtaacataacaatgaatataattactatacttttcaaggatttacaaaatgtatactcatagtctaggagttacatacttacaggaatttaaactgacaaaggcaccaccctcattttgaacaatagcta

SEQ ID NO: 393320 - DNA, 206 bp, Homo sapiens
cctgagggtgtctgccctggaacatgggctggggccgctgagtaagatgggattttaaaaatactttcttttcttgccaaaaggtagatcacgacttacaaaaaaaaaaaaaaggcagtgattccgactgaaagtatagcacgacttgatgggtacagctgtgggtcagggcagtgtacctctctgacacagtgggggtactgggt

SEQ ID NO: 393321 - DNA, 465 bp, Homo sapiens
actgggactacgtgtgcgccactatgcctagctaattttttgtattttttgtagagagggggttttgccatgttgcccaggatggttttcaactcctgggctcaagcaatctgcccgcttcagcctcccaaagtgctagcattacaggcgtgagccactgcacccagccctgagcttttgtgtggtaaaaatatgaagtatagtgcaacatgatggttccagaaagactaacaatgtcctggtgcataattaggcagcagactgccatgattccagaggaattaataaccatctgtaaaactgcaattatttttcttttggatgggctataacaccaaaagagaggaaatagaggaaagcagaagtattggcacagaaagttcataattaagtatttatccaccaacccataatagctcgggtgctagctattccaatcagcttatgtaacatgtgaaaccttgg

SEQ ID NO: 393322 - DNA, 1262 bp, Homo sapiens
caggctgtctccaagtcttcagaggaagtattctgtggccaccccagaaggactgcctcatccagtgaagacaacagaaatgcctccctgagagctctgcttggtctgtgtactgctcaatttccccacccaacctggagtgggactacatcaaacttaaaagcttctgcacagcaaataagacaatcaacagagtgaaaagacaacctatacaatgggaaaagatattttgccaactatgtatctgacaagaagataatttccaaaatatataagaaactcttacaacttaacagcaaaagaaagaaagaaaagaaagaaggaaagagaaaatgaagaaagaagaaaagaaagagagaaagaaatttaaaaatgaatgagccaagggcttgaacaggcatttcttcaaaggacacatacaaataaccaataagtgcatgaagaggtgtttcacactactaatcattagggaaacacaaaccaaaaccacaatgaggtatcatcttatacttgttttaagatggctattaataaaaacatgcgaaataagtatcggtgaggatgtggagaaattggaactcttgtacattatgggaacataaaatggtgcgatagctacggaacacagaaaaaaaggttcctcaaaagattaactgctatatgatctagcaattccacttctggtcatatatccaaaagaattgaattcagaatttcaaagagagctccatacacattgcattattatttacaatagctaagatatagaaaaaatttaagtgtccattgcacttgatttgatgaagaaaatgtgctatatgcatgcaatggaatattattcacccttaaaaaattaagtcctaccatttgtgacaacatggatttacccagaggatattatgctaaataaaataaactagtcaaagaaggataaacatggcatgattccacttacatgaatggctgcctggagcttagggaaaacggcagttcttcagagggtgtcaagttttgataatgctcgatgaaaaagttctagagatctgttgcacaacaaaatgcctacagttaatgcagtattgtatattgtgcacttcaaaacttactaagagcgtggatctcactttaaatgttcttactaccagtaccacagccaagatcatcaaaaaacaaaaggaaaaataaaaatccgatgcgccccgagctgcttttcgtcgtcctagcgcacatcgtcgtcatctctctgctctctctacccatat

SEQ ID NO: 393323 - DNA, 1235 bp, Homo sapiens
caggctgtctccaagtcttcagaggaagtattctgtggccaccccagaaggactgcctcatccagtgaagacaacagaaatgcctccctgagagctctgcttggtctgtgtactgctcaatttccccacccaacctggagtgggactacatcaaacttaaaagcttctgcacagcaaataagacaatcaacagagtgaaaagacaacctatacaatgggaaaagatattttgccaactatgtatctgacaagaagataatttccaaaatatataagaaactcttacaacttaacagcaaaagaaagaaagaaaagaaagaaggaaagagaaaatgaagaaagaagaaaagaaagagagaaagaaatttaaaaatgaatgagccaagggcttgaacaggcatttcttcaaaggacacatacaaataaccaataagtgcatgaagaggtgtttcacactactaatcattagggaaacacaaaccaaaaccacaatgaggtatcatcttatacttgttttaagatggctattaataaaaacatgcgaaataagtatcggtgaggatgtggagaaattggaactcttgtacattatgggaacataaaatggtgcgatagctacggaacacagaaaaaaaggttcctcaaaagattaactgctatatgatctagcaattccacttctggtcatatatccaaaagaattgaattcagaatttcaaagagagctccatacacattgcattattatttacaatagctaagatatagaaaaaatttaagtgtccattgcacttgatttgatgaagaaaatgtgctatatgcatgcaatggaatattattcacccttaaaaaattaagtcctaccatttgtgacaacatggatttacccagaggatattatgctaaataaaataaactagtcaaagaaggataaacatggcatgattccacttacatgaatggctgcctggagcttagggaaaacggcagttcttcagagggtgtcaagttttgataatgctcgatgaaaaagttctagagatctgttgcacaacaaaatgcctacagttaatgcagtattgtatattgtgcacttcaaaacttactaagagcgtggatctcactttaaatgttcttactaccagtaccacagccaagatcatcaaaaaacaaaaggaaaaataaaaacgatgcgaccaggttaatacttccccccccataatttattaatatca

SEQ ID NO: 393324 - DNA, 535 bp, Homo sapiens
tctttaagttgccagcattgaaacatttaattccatcacgtaaaattatttagggcaggtaattttagtcttttcacacatgttggatttagattcccctttacttaacattcattctaactgacaaaaaaagttgccaaatatatgctaaggtactgtgttttgtgctctaagatacaccaaactgaagggtaggtcctatccattggatagtcttacttcaaaagcaactttaagagcccctaaaactgtaaaatttaataagccttagttcactatttaaagttccttattctatgtctatgttgtgccattctgcataatattatttgccaaacaataactcttattggccagaatcagattcaaggtagtagttttcctaattgtttctcccctttccacaacaaatctcaagaacttaaaacattctacttatttacctgttttgacacagcatttataaacccagagaccacttactattaatacaccaacttcaacccctttctaccccagcctcagttcagttctg

SEQ ID NO: 393325 - DNA, 503 bp, Homo sapiens
tgttttgttttctttttctttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaatttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttt

SEQ ID NO: 393326 - DNA, 244 bp, Homo sapiens
taattcctttaagggcttctgtataatttgttcttaccgagttgaaaatttatttcttataaaatttcatccttttgtttaggttttcatatatttgcatggttttttttttttttttttttgagatggagtttcgcgcttgttttccaggctggagtacaatgacgcaatctcagctcactgcaacctccgccacctgggttcaggcgattctcctgcctcagcctcctgagtagctgggatt

SEQ ID NO: 393327 - DNA, 506 bp, Homo sapiens
cacctttgccctcctagggggaggctcaaatggtcaaacccggatcctcgttgcttggcgaggcctgcattgtcactacacaggcagggggctcccagacccaatgcctcacctggaccgtgccctcctcagctgagactcctccattccattgccctggaggagccgactgtgccagggtcagctcagccgtgttcccgctccagcccagctggtacacaggatcccctcccatcagcagcactcggctccagatacaccacgggtgctgcttccttagatcatcccagacagaacccgatgccccgagctggccagcagccacaagagtagccccagagctccagctcaaagcccacaggggctgcttccatttccggcaacactcagcagaggcaaggatggggctgggagtcaggcagacctagatcctgagcccagctcctcactggcttgccctgtgcctggggatggagccccgatttcatttctaaaaatgtggtcct

SEQ ID NO: 393328 - DNA, 296 bp, Homo sapiens
ctctttgcaaagggctaaaaaatgaacatcaggaacagatcctattcacagaatcgaaatttaaattacttactaatgctttcttagcataaaaaattataccaagataccttgtcaaattctgttcatctttcaactatacagtggaaagcctactcaaatgttcaatttaccccataacgcaccttcctgcctgcttaaacaaatgtatttagggataaatgtttttaatattattctagctctcacatggtcactgacagaaacaagaacttattcatgaaaaaggttaaaga

SEQ ID NO: 393329 - DNA, 168 bp, Homo sapiens
ggtgcttaagttctgcaggttgtgaagcaggctgtaaacacaggtgacattattattacaaccccccatgctgccgagggggcgctgctcccacctgcagtcccaggccactttgattcatcacgtgccccacaaatgtcactgagtacctactgggtcctgggcgct

SEQ ID NO: 393330 - DNA, 962 bp, Homo sapiens
tgagaaagcaccaagcccctttattttttctcccaaaagggctgcgaatgaagtagattcatttctaaaatgccctgtacagcctcgaggtttttgataatttatggagtgatatgatcctattaaacgggagtctgcggctgtttgatctagctggtagctctaaacctgtggagagaaaagaaaggtctggcaggtcagacacaaagatctaatgtgtggtgtcagggtggggctttatgggtaatttttattttatgttttgcttatttgcattttctactgtccctataaagagactgtattgcttgagaaataaactaagagcagcaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaagcacgcggaacgcgcagcagtcggcggagaaaaagcgaaaaaacacacgaaacgagggccgcagcaacgcacaacaagcagaaggcgaagacgggagcaaacccgcaacaccgcgcgcgacgccagaagcgagtaccgctgactcagaaggggcagacgaaacgccgcgggagacacccagcagaccgacaacgcagccagtcagacaaaacaaccacggtaagcgacaaacaagccgaaacaggagcgacagcagagccaaagagtcgagcagaggaaggagacgacatgatgaaggaaagcatgagcgaggaagcgagaggaaaagaggcagacggaggacagcaagaaacggagcagcacacagcgaaagacacaagaaacagaaaggcagagccagagaggaggacagacagccaaacaacacgagagacagaagaaggcgaaagcaacagagcgacggacaagcgcacccgtcgagcgacgagcctggaaacaaacgaagagcagccgcgagcgagcgccacc

SEQ ID NO: 393331 - DNA, 424 bp, Homo sapiens
tgagaaagcaccaagcccctttattttttctcccaaaagggctgcgaatgaagtagattcatttctaaaatgccctgtacagcctcgaggtttttgataatttatggagtgatatgatcctattaaacgggagtctgcggctgtttgatctagctggtagctctaaacctgtggagagaaaagaaaggtctggcaggtcagacacaaagatctaatgtgtggtgtcagggtggggctttatgggtaatttttattttatgttttgcttatttgcattttctactgtccctataaagagactgtattgcttgagaaataaactaagagcagcatttgggagtgccagtgtctctgttgcttaatgcagaaaaaataagcactgcagaataactttactggcttcaaaaagggggaaatatccaac

SEQ ID NO: 393332 - DNA, 531 bp, Homo sapiens
caactaagggggaaaaaaagaggatcatggctgccaggtctgtgtaatgaagctatgagacaatgggataagagttttttggattcagaattaatagaaaatgtctcagcccagatgtcatttgtccaatgtcacgcctaaggtcgaagaagaaatcctcaaattcctaaaatatcacacttcacctccccatccacgccatgcaacatcaagaggccagaatttggccacgcatagtggctcaagcttgtaattacagtactttactttgggaggctgaggcagacaggttgcttcagctcagtagttcgagaccagcctaggcaacatggtaagactatgtcgctacaaaaaattaaaaaaaaaaattgctgggtagggtggtatgtgcctgtagtcccagctactcaggaggctgaagtgaaaggatcacctgagcctgggaggtcaaggctacagtaagccgtgattgtgccactgcactccagcctggatgacagagtgagacactgtctctaaaaaaaaaaaaaa

SEQ ID NO: 393333 - DNA, 1009 bp, Homo sapiens
aagaaaaagaagcagcatctgcaggatctccagctaggggatgaagaagatgtctggaagagaaatcccaaagcttttgcaattcagtctgctgtggggatggcttgatcctttcacaggactcaggatttgaagacaaaaaagcatcatattccagtggttgatcagactccactagagccgccaccaatagtgatagtggtgacggggcctccaaaagttggaaagagcactttgatataatgcctcattgggaacttcacccagcagaagttgaccgagatcagaggccctgtgatgatcgtgtcaggtaaaaagctccgactcaccattattgaatgtgggtgtgacattaacatgatgattgatctggctgaagtagcagatctggttgccaagctgttctacctttctggaatggtgcatggagaatatcaagaccaagaaatccacaatctgggccattttattacagttatgaagtttaggcctctcacatggcagacgtctcatccttatatcctggcagacaggatggaagatttgaaaaacccagaggatatctgaacaaaatgtgactggcaggtgtcactttatggttatttaagaggagcacacttgaaaaataaaagccaaattcacatgccaggtatctactgagcgtttcagtcaacaatacagctcgtgttcgacaatattccttgatggcagcacagccagccagcattatcttataatgacaataatatcgcactgagaagccttttaggaaaatcaggatggatgtgaggcatctttctgtgaagaaaagcatcccagaagattctgattttcaccacagctcaatcattccaaactttgctgctgattgaaatcacctgggaaacgtttaccaagaaccttgatgcccaaagccatacccaatactaattaaattaaaatgtctcatgttgaagatgaggcagatattaaagcttctcaggcgattttaatgtgcagcgaagtttga

SEQ ID NO: 393334 - DNA, 443 bp, Homo sapiens
ccgggattacaggcatgcgccaccacgcctggctaattttttatttttagtagagatgggatttctccatgttggtcaggctggtctcgaacccttgacctcaggtgatccgcctcctcagcctcccaaagtgctgggattacaggcgtgagccaccgcgcctgacagaagtttttttcttttagtagtttaaagatgttgccccaatgtcttctggcttgctttatttttttcttctaacaagaagtcagctgtcatttttatattttttcctctctatgcaatgtcttattctctgattacttttaagattttctctttattcctgattttaagcaatctgattataataggtagtatatatattatacagtaaaatataatatagtttcatgtttctttcgtctgcggttctttgattttcttggatctgtggacatatg

SEQ ID NO: 393335 - DNA, 318 bp, Homo sapiens
cctgaaagaactgttccctcagcgtctttgaagatggaggagttggcaacagctggagaggaatgccattggtgggacagcccaccaggagatggggagccaggtttagaaggagaaattgttggaccccaaggcaaaatttggctacctcagattttaccaggagccagcaaaaatttctaatccaagagataatgatttcaccagctctgagatttcagatggaaactaccccaggttcctggactgagaaagttcctgaaatgtggggctttcaatgcccaaaccaggaaatcccagcaaaatgaggtgactaga

SEQ ID NO: 393336 - DNA, 526 bp, Homo sapiens
gtggttctgtaggaaaaagtattaagacgtctgcaactaactttcaaatgatcctgccaaaaaataaaaataaatgtgtgtgcatgtgtgtatgtgtctatcggatgtgtttgcagagaaaaaagtttgaggggaaatgtaagaactggtgactttaggggagatgtttgcagctattccttgttctgttctttcagcattttagtactttgaaaaattatcaacataaaaaattataggaaacaggctgggcgtggtggctcacgcctgtaatcccagcactttgggaggccgaggcaggcaatcatgaggtcaggagatcgagaccatcctggctaacatggtgaaaccccgtctctactaaaaatacaaaaaattagccgggcgtggtggtgggcgtctgtagtcccagctactcgggaggctgaggcaggggaaaggtgtgaacccgggaggcagagcttgcagtgagccgagattgcgccactgcactccagcctgggtggcagagcgagactccctctca

SEQ ID NO: 393337 - DNA, 393 bp, Homo sapiens
gtggttctgtaggaaaaagtattaagacgtctgcaactaactttcaaatgatcctgccaaaaaataaaaataaatgtgtgtgcatgtgtgtatgtgtctatcggatgtgtttgcagagaaaaaagtttgaggggaaatgtaagaactggtgactttaggggagatgtttgcagctattccttgttctgttctttcagcattttagtactttgaaaaattatcaacataaaaaattataggaaacaggctgggcgtggtggctcacgcctgtaatcccagcactttgggaggctgaggcaggggaaaggtgtgaacccgggaggcagagcttgcagtgagccgagattgcgccactgcactccagcctgggtggcagagcgagactccctctca

SEQ ID NO: 393338 - DNA, 552 bp, Homo sapiens
tattgatgccccaaagattattgggaacacctctttagacagaagaatttgggtttattggtacttgttgcaaccaaggagaccccaccccatggagaactgtggagagtctcagtaagtgggtgttaggagggacatatgggatttgggtttgcgttgggtgattttaggaatcgttcaagggattgaagtattctggttggatgctgtccggaactaggggcaattctacagtggaacatcttgttaatttatctaagaggtgaaggaaaggtatggggctaaagctgtatttggtcaagaagccgccagcagtcatgtagatgggaaaggcggtgtttggtcattgtcatggttcgttgtggtttgtatggtgatcttgtttttatctgtgcacagagtagtcttgtttttgttttgccccatcacagccatagaagtaccttgtctaacgttggtgttctgtgaagctgtgttcatccgaacaccatggcccagcagctagtgctgggtcaggttcctgctgatggctagtaggggctcctttcttct

SEQ ID NO: 393339 - DNA, 329 bp, Homo sapiens
cagcaacggacaagttagttaacttaaaggggggcatcctcaaggcagtaaactggagccaagtgggttaaatccttcttgctgctattaaggggaggagacaggtttctgcagactctacattttggagagaaacagaaaagaatgtccccaagtctcctttgccctgcgatgctggggcagattggcaaggtcccaagagaagcacaatggtaaccgacgctgcccttggctgaacttcttctgttaaatccttcggatggatgctggaatcgaccttggtctctagttcgactcccgtgcaacgtgttgaggaggagccacctcct

SEQ ID NO: 393340 - DNA, 473 bp, Homo sapiens
ctgccatctccattcctctctcttttcttgcaatctgggtagaagttctttaatatgaacatttcaaccagcttcattctaccgtgtccactatcagcacattcaaactgatccagccaaggctgtcatcttaggccagggattttttaggaatctattatgctgtgatgcggctggcacccctttgactcactgtatcaccccagggttcttttcatttcagaagcccaagagggcagaaaaagaagtaggtgagcaattaaaccctctgagtcaggagcgtctccccttgcgttaagcaatgttgtagaacatcgtgtttagcaagctcctagcagatgagccacgtggctgctgagcacacacgcctgcttgctgctgtgagctcaggcaccatcatcatgtcttttccatctctggagcgaattgtaagggccacttaataacctgtaaatcacagagagttaaaggtg

SEQ ID NO: 393341 - DNA, 324 bp, Homo sapiens
ggcaaaggcagagaggctggacagccttaggcagggccagttggcacagcaagttgggccggaaacaaggttactgtttgtgtcaggtggaaagagcttgatggtgaagggctcttggaatcccaaaccaaggagtttgaaagggaatttggtagacactaggaatcactgtaagtctctaactgggaagaataggctgaaagtagctgtacagagaggatgtctatggaaacagttctttgtaggatggaaccaagaaggaagaaacctgaaacaagaagaaagaaatggcaggtgtggtgactcacacctgtcatcccagca

SEQ ID NO: 393342 - DNA, 421 bp, Homo sapiens
tcttgaactcctggcctcaagtgatctgcctgcttcagcctcccaaaatgctgggatcacaagtgtgagccactgtacctagtcagaagtctctaatgttattgttgaattctctatttcttccttcagttctgtcaggtttttctccttttatttcagggctgtgttttgggatgtatatatgtttatatttgttatacctgtttgatggatagacacttttatcattataaaattccttctttgtttctagtaacaatttttgtctgaagtctgttttgtctgatattagtatgatgactccagctctcttggttaccatttgcatggtatatcttttttcatccttttactttcaacttgtttgtgtctttgaatgtaaagtgtgtctctcatgaagacagcatatagttggatcatt

SEQ ID NO: 393343 - DNA, 217 bp, Homo sapiens
tttatgggctatttcctcatggtggtagtggaagtgtttcaggcttactcaactggcatgattgcagccttgggcaaggagtagtgggactgacctaaaagactgtcctagttcaccacttgcaggtggcaccccagcatgggccgattaatgccgctttggttgggaatgggcttaggtgccttttctacaggagcatcatgggcttctcccaaat

SEQ ID NO: 393344 - DNA, 171 bp, Homo sapiens
catgtgaccccactgctcacacatgaccctatgtcacctctggcccacatcccatgaccttgcagtccacaaatacacacgtgtccgagtagtgaacactgcaactgcttactatgaatgcatacgagccagctaaacaacagggcccactgcaggaagcaacagcacagg

SEQ ID NO: 393345 - DNA, 380 bp, Homo sapiens
ctttgctattgtgaattaggcatcgataagcatgggaatgcagttatctctttgctatcgatttcatttccttcaacacagtgctaccatcatcctcgtgaccatgagtgtacatgatccagaggcaaagaggtggtctagtgaggaaatagtctatgattgtaaaatttttgtcaagagtgtaaacatacgaaacaagttggaagagttgggctgaatcacagtagctctaagtgaaacccactgaccttaccaatttccactttccaagcacggccattgctctcaccattgggaatctgaagagtcttggggtatatcaagtccatgaaggaatcctgagagtggctacaggactgaaaaagctgaatcctaaggct

SEQ ID NO: 393346 - DNA, 203 bp, Homo sapiens
tgtttttttcagtgactgtatatctggctccctatagaaaaagtctgctaactcctaacctgggtaaacaaatatgtatggaatacagagacctgacaagggggacataagccaccaagatagaaaaataacagcctctcaaagttcgcagaccctctagaataaaggcagtaaggcaaggtatcctttagacaaagctctat

SEQ ID NO: 393347 - DNA, 103 bp, Homo sapiens
accacaactgcatgaaactctgtgtctgggaacatcccaagagatggactcaaaagccacaactaagacagtgccttgaaagagactattgtaatttcaagtt

SEQ ID NO: 393348 - DNA, 359 bp, Homo sapiens
gggaaggctgctggagtaatctgagaaatccccaactcttaaaaaaacagaagaaaatgtagtcccttatccatttgaaccctcacaaaatccctctgcctaaatctcagtatggtgaaagttgcaactttcatagaaatttacaacctgggaaacagtgagggttaattctttgatgctttcattaaaaaaaaaaaaaaaaaaaaaaaagtagccgggcgtggtggcaggtgcctgtagtcctagctactccagaggctgacgcaggagaatggcatgaacccaggaggcggaggttgcagtgagccgagattgcgccactgcactccagtctgggggacagagtgagattctgtctc

SEQ ID NO: 393349 - DNA, 283 bp, Homo sapiens
tgcaactacagtaagccaaattctgaaaacaagaggtggttctgcaagttatttcacagctaaacatcacgcctagctataatctttatattaaaggtaaacacaaatcagttgctcattccaagtttgggttttcatcccctttgaaacaacaaagagtgtacccacttcagaggccagtaaggaattggcctgccagcccagccccagcaaaggagctgctgcagataaacagtggttagctctgaagtcatccagacagaggacacttttacatgacccc

SEQ ID NO: 393350 - DNA, 388 bp, Homo sapiens
ctggagagaagccctataaagtgtaaagaatgtggaaaagccttcagtcatcccagttcatttagaagccatgaaaaaatacaccctggcagaaaacttcttgaatgtaagtaaagtgggagttttcaacttgcccacctccttacaaaaacatgcaataagaatgtgctagatataaagcttacaaatgtgagaaatacaggaagtttttcagttttaacaaatactgtcaaagtcatgtgaaaattctcactagaaagaaatccaataaaggcaagttgaggcatacctgtttgttattcaggaatttgctataaggttatactgggggagggggtgccatgtttaaattcaatggtatcttaaggtaaaactgtaatttaagccc

SEQ ID NO: 393351 - DNA, 328 bp, Homo sapiens
tcttccctctgcacgtctcatttaaaatgatgatgggccaggtaaggtggctcacacctgtaatcccagcattttgggaggctgaggtgggaggatctcgagggtaaggagttggagaccagcctgggcaacatggcgagaccccatctctactccccacaaccccccaaaaaaaagattagctggtgtggtggcatgtgcctgtggttccagctgctcagggggcagaggcaggaggatcccttgggcacaggtgttcgaggttgcagtgagctgtaatcataccattgtacttccgcccgggtgacagaacgagaccccgtctctt

SEQ ID NO: 393352 - DNA, 193 bp, Homo sapiens
tgataggtggatacagcaatgagccaagatcatgccactacactgcagctgggactacaggcacacaccatcatgcctgactccttttggtattttttgtgtagagatgtgtcctcattatgttgcccaggctggtctccaactcctgaactcaagcaatccacccaccttggccttgcaaagggctgagatt

SEQ ID NO: 393353 - DNA, 332 bp, Homo sapiens
taactgattgtcaccagcagaccaacagacagactcacagcatccttctccctggtgtgagcactgcttaattcacatttatgaaaatactttaagacaagggcactgtaactcacatagaatctgaagtggccttgaacagggagctggtccagctgcctcttagtgtgtctgacctccaggtgggcggactgagatgcgtgcaggtgttcatggtataggcatccttgtaaacctgctctggttaaggataaataggcaaagttgtgctaatgctgttcctacagcagcctttgccctggactgactccagaacagctggctgactgaca

SEQ ID NO: 393354 - DNA, 411 bp, Homo sapiens
acagacaagcgccgggcagccgggcagccaaggagagcagagaaatgggcggttgccagtacaggacacgaggtccagggagttctcacagaaggatcacgggagaagtcacagcgtgtccgcaggaaaggaggagagaagggacaggccagtccgagtctgcagcagggcctgacaacagacagcacgtgagggacagcgacaccggggcctgatgcagatggcagggagatgcgaagcgggactcaaccacctgctggtgtgaagaagggagggacagacaccacaagggaggccccaggagtggctggcaccttcagggcccccagcgtgcaggggcatctcacaactaaacacaaccagcgccccagacgccatcccgactggggaaaaagttgtagtgggcactat

SEQ ID NO: 393355 - DNA, 596 bp, Homo sapiens
gaaaacattttctatttgtggagactttaaagaagacggctgtcctctcatcaacaaaatcatgaactgttaatgttttcaaacattcctttgggtattgcatttttatgaagcaagaacaagaagaaccagaaataatgataagctagaacctattagagatgtgtttgaaacctggaatcggtttttacaaactggatatattccaagttcatgaatgacagttgataagcaattagttgcattcagaagatcattttgagtagaatatcttcaaaaccaagaaaatatagattaaaaaattgagttagctatcattaaattgttattaatattgctaataaagttgttttcaacttttttcttctgtatattagttttataatatacctttcttctgtaaattattttttaaaatgacttaaaaatattaaaaattaaagggttccttggatgtagttggtaaatgatgactatttttcctgactgaaggctaagtataggcaaatcctgtgaatcaacaattccttttgtggctgtatatgccaatggaattaactcacaggcccatacagagacacatatatgatgttcat

SEQ ID NO: 393356 - DNA, 662 bp, Homo sapiens
gataagaagccattaacaatgcatcactttaattaaacactctaaaagaagtggagaaaaaaatcatgttagtattgaaatcctttgcctttccaattccactggataaaaggggtccttcaggtctcagccctcccaacagaaccagttttctcctctcagaatcagctgagcaatgactcttcgctgaaacaagctggtggctgttccctactaggaagcagccagttagtttggtaagggctggaaggggcttgctttccctggcaccatgcctgaaggccacctagacctgtaagaaggcagcccatgaaaatcccagcctgctgagagctctgccatccaaggagggtgatgggttttacccacctcagcctaatgactccaaacaaactggctgaaggtgaaagggttggcagggctgtctggggaggaaaaccacccatccagaagggtgggcatgtcagtcttacgagtgctgccacgcatgggaaaggtgtgggagctatactctagcctggtccacttctgtccccacattctacctggaggcttctcgacctcacaccagggcattaatctgcttgggcacacagtgaatcagaacacaatggttttaatacctgcttggccccaactctgagaacagggacctgccactt

SEQ ID NO: 393357 - DNA, 306 bp, Homo sapiens
ggtaatcaaaggctgggggcacaggaggaggaaagagtcctagagtgaaacagcccaaaacaatgtggcaaccccgctgatggcagagaaagcacagcagctgacagacgagcctggcttggagctataatggacttgctcttttaaagcaaagactttcaggccaacagagacagacccttctgatggcagcagctgcagatgctaattaaagggcaaatctcacatgtgttcagtttggaagtagcggctgcttctctgttggtgtttgcatccataccccagtaccaggaaggcaatttccat

SEQ ID NO: 393358 - DNA, 282 bp, Homo sapiens
agggctaagcctagggaatggaaaggaaaaaaattatgactgcttgaggtgggtaataaaaggagacagaagggagagtaagtgctctaggtgcccagcagaaagtataaaacccttttaaaagcccagcagacagtttgttctggacaccatatttcataatctattcctgtcacaaagtatgtgtatctgtttgatttgggggaaagggaaggctattttccatcccatagatctcctggtttctaattttaagagccaagagtcccattctcaaagata

SEQ ID NO: 393359 - DNA, 447 bp, Homo sapiens
cggaattccttgactttctaggtgggaaagggtaaatgaagtagcgaatgctgtgaccaaaagcgtatgtaattttctgaagagtgattttaaatcagattgtatttcttgagtacaagagtagtttgaaatcagattgtatttcttgtaatcttgaatattagcccaaggactgtgaaatttgcttcgctaaataagggagagttgtggctggttttattaagctgccatgggagagtactatgaaggcaacttagtggattgaagagggctggagacagaagttagggagagtccgcagtggacagacaggtaagggcccaagccaggcttggggtcagcgggagggggaaagcgcaaggggaggagatgttgggaaggaaaaatgaccagatttggtgattaattagaaatcagtgctaggaagaagcatgcaaatatgactaa

SEQ ID NO: 393360 - DNA, 571 bp, Homo sapiens
cgtcgcggccccgcccccggacgcccagccgcggtcccagcgaccttcgctttcgtggggaagccggactgcgccgtgtcttcctgaagaaggctgggggatcagtgtccttcagtgatgtggctgtgggcttcacccaggaggagtggcagcatctggactctgctcagaggaccccgtacagagacatgatgctggagaactacagcctcctcctctcagtgggatattgcattaccaaaccagaggtggtttgcaagttggagcatggacaggtgctgtggatattagaggaagagtccccaagtcagagccacctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccc

SEQ ID NO: 393361 - DNA, 692 bp, Homo sapiens
gagaatcaaagtcattccatcctaaccccatgatctggtaaagagaaactcatacttccatctgttctaatttatgtgaggtacctagatgatcatattacttccctctacgagacactggtgacagagagtcagccttttccttctgcactggcttgggcacacatggagaagtatattagttcattcaagaggacctcaaggaggttgctggctattcaggaaatatatttccttttcctaaggctggatttggttttaggaggatggctgtatgcaatgagaatggcagtttatttgttctgggaacaatgtatttttgggtttttgtgtgtatgtatgtcctaaatccaatttttccccagtgggatcttctttatttttctagttcatatatagcttttataagcaagtgataattaatggaacagacattttagttgttgttgaatcctttccatttctcttcccatcataagggccagcttcagatgctgttaggtcctaataacttcctggtgataaccatgtggcccacccatcccattaatttctgcttttattctgaagttattgaagaaacaagagtaattcttgtatatatttttgatgcttacctaataagatactaggctttgaagaaatgcaaataatgtctaaatgttcaatctatacagcttcaatattagcaa

SEQ ID NO: 393362 - DNA, 456 bp, Homo sapiens
gagatagcataatgaacaaaatggatgtgctctctgcccttgtgatttggacagatgcttcagttatctttttctgtgtttatattgattatgtttgtatgtatgtgcgtgtgtgtgtgtgtgtgtgtatcgactgttttcttcctcctcccataccattccccaaaaaaggagggggtagggatcaagctacacctatttgtaacccagttttttcaattaatggctgggcatgtccttccaagtcattacatatagatctggcttatccttttcaacagctgtacccacattcttcagtgcagagagaccacgctttattccagcattcccccactgctggtcctttaggttgttcctctgagatgtcttttttttttttttgagacggagtcttgctctatcgcccaggctggagtgcagtggcgcaatctcagctcactgcaagctccgcct

SEQ ID NO: 393363 - DNA, 249 bp, Homo sapiens
tctatacagggagtgctgcagttgcacagtgaaggacactgaagcagcgtggggaagctcctgaattttctggagctgagcgcaggagctgagacctgctaagcaaggaaaggcagtggactaaggctcacctccttccccagttcctcctcctcccaactggtgctccaggacaccacatcacaatgcatttgtggatattttcctcgggattgctctgaaatcatttttcactgtaagccatcttgg

SEQ ID NO: 393364 - DNA, 386 bp, Homo sapiens
agtgggtatctcagtatctactcaacttttcatcctaagtgatcctcttaagtcagatcgtgtcaccacgctcattgtccttactactctgtagagaccctgtccttctaaacagaacattcctagcaggctcccacttcagagcctactggtacttccctctgcctggaatgttttcccagtagtatggctgtcactcactttatttcttgtaatgtcatcaaagaagctattttttaccaacctatttaaaataacatcccttctcattaccctttctgtttcctttccttgctttatttttcttcacaaatgaatcatcttctgccatataataagttcacatctatacctgtagcatctaacaatgtacctggcaaaatagt

SEQ ID NO: 393365 - DNA, 376 bp, Homo sapiens
gtttcttgtggctggagggtggtgggtgggtgtgtaaaggcccaaattccatcattaggtgggataactcctgaaatcttacatactgcttttaattagatgttcttttcacatattatacaagaacatgtacacaacaatcacccagctgtattgcttgagactagagaaacaaatttaccaaaaatctaagtatctttaaaatgagctcaatataacttagtgacctcacaaaatttcagaagtagtaatgccaaaactcgctaactttcatctttagtcacatgcaaagagaaaaaaaccagacggacttctttttcatagttaatagcagaaattattatagcactctgctgtgccaacatttgagtttcaa

SEQ ID NO: 393366 - DNA, 1564 bp, Homo sapiens
atggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 393367 - DNA, 376 bp, Homo sapiens
gtggagcttctggtcacctccgacggggcggacgtccgatatctgggagaggttggttcatccgacgggggagggctgggatgagatggccctgtacctgtgagccccctaggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatcgtgagcagggcggggcctgacccccggcccgggcggggaggtgcaaccaagcccagaacggctaaactggggcgcggaggtgggggtag

SEQ ID NO: 393368 - DNA, 1231 bp, Homo sapiens
atggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaaggtgagggcggaatcaagggctgccggccgcctgctctgtagggaggaccacgagattgggcccgagacggggcggttcgcaggcgcagtctccccgcgccctctggcggcgagcgctaagcttgcctggcacctgcgtcctcccgagtccttgcagagccagttcgcgtccctttccagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatcgtgagcagggcggggcctgacccccggcccgggcggggaggtgcaaccaagcccagaacggctaaactggggcgcggaggtgggggtaggctgggcttaggggtcagagtggaaaaggtggagtcggagccgagaggggaaggagtctggatgagtgggtgcggcccaggcctggggatgagaagagttgaaggatgaaaagcagagaggaaagggacagataccaaattccaggttgggagttggggtcccagagcagacaaaagttgaactaggcaggagttgaactagggacagactaaaagtgacataggtggggcacggtggctcatgcctgtaatcccaacaatttgggaggccaaggtgggcggatcagttgatcccagaagttcaagactagctagggcaacatggcgaaatcttgtctgtacca

SEQ ID NO: 393369 - DNA, 612 bp, Homo sapiens
ataccacctcatgattcatcttggagtggcccaagcctccctccaccttgtttaaattgccccattcccggagaccttgccctgtgcccagcgctgggctgagcaatgctgaccaggaagcagtgatcactgccccactagggctcaccttccactagaggaaagagacctgtccctagacagtgatgacccagagtgggcatggctggggtagggaatcccagggggctacaggaacccagagtgggcacctgactcagcctgggaggtcagggagtgcttccaggaggaggcgatgtctgagctgatacttaaaagatgatgaggccagacgtggtggctcatgcctgtaatcccagcactttgggagactgaggcaggcgggatgcttgagctcagaagtttgagaacagcctgagcaacgtgatgaaactccatctccacaaaaaattttggaaaaattagccaggcatggtggcacatgcctgtaagtcctagctactcaggaggctgaggtgggaggatggcttgagcctgggaggtcaaggcttcagtgagccgagattgcaccactgcactccagcctgggcaacatggcaagaccctgtctca

SEQ ID NO: 393370 - DNA, 996 bp, Homo sapiens
gtattgtcgtctcctcacagaagcagtaacagacttatccaaatgagtcttatgggatagatgtggccaagggatagcggactagagaattgagggtgcgttgaaggtcatacagttttgcattttatagtccagactacataggatagaaggtaaaatcaggtagcagggaatagagggcccagagaataggctcagtggaagtaaggaatgaaaaatgttgaggccagaaggttgggataaggaaccaagttgtatgaatgtaatgtttttgggaagaagcagttctagatgatgaccagatcagggattctgtcagagggtagagaactgaggtttactggaccactcaactgtagatatccatcattactctttgttttgtggctgaggtgttaggatggtttagttgtcttgtattacagtaggatttaaggttgaggggatgatattgtgggtggagagctggcttataaatcttactcactgggaataatttggactcctgtcaatgccactgataagaatagggtgatagagagtctggcaggctgtatggacagtgtgaatttcaaaagagcctcttgatttggaattgaaaatatccaagaaaattttccttgtcttcttgttcccagataagagggagagatgtgaggattagcacccttatttgagagggctttgagggatgtagtgccattcatggaaagttggagttcagttaaatgtggagagatcattttataaaatggctgaaggtatagaggagttaatcatcatataggggttctagagatagagggaaaatttttagatactgaattgtaaagttttaaattaatgtatttgtttttatacaatatattctactttcttactatatagcattttgctttttaaactttattgaaaaataattttagacacagaaaaatggcaaaaataatacaaagaattcctgtgtatattttacccagtttccccaaataatat

SEQ ID NO: 393371 - DNA, 112 bp, Homo sapiens
agttaacttatggtccagggaagatacttttggaaatgttgatgtaaatgaacaattcaacactaggtgctctgattcttttgactacattttattctctctcttgctccat

SEQ ID NO: 393372 - DNA, 320 bp, Homo sapiens
ctccaactgggcgtctgggctgtctgggaagaagctcatgttcccactgaggtcgtggccacagttgctcctggtgtttgagggcctctgtgaggggctgcactaagcattttacaagcatttagtacagccccagatcatctcaggcctggagggaagaagtaatttgcctgaggtcacagagctggtaggtgggggacccacatgattgggaagcaagcttgtcctgctctgagcttcagaagcatgtcatgggcccatccatttacgacttcacactttctgtccttggaaagtcaccgagagcgtgcaccataatg

SEQ ID NO: 393373 - DNA, 642 bp, Homo sapiens
  misc_feature (13)..(13): n is a, c, g, or t
gacgctctctctngtggggcagggcaccagcctatggagcagccctgatctgcaaggagcggatctctggcgctgctgtgcacagctgcttccatgaaagctgctgcctaacaccaccagctcacccttgaatctttgctggttgccagatgatgcaggacaggcaagccccaagactggggcttagcctgggagagttcttggatttgccgacgctctctctgtggggaaatgatcccagattatccaggtaggcccgcggtagtcacaagggcccttgtaaaagggaggcaggagggtgcgagtcagaaaggagatgtgaccatggaagcaggggccagaatgacgtgggactgcgggtcagggaacatgggaagcctctagaaaccagaaaaggcaacagaaggattctctgctagagcctccggagggagcccagccctgccaccccatgttaggctcctgaagccaagatgcccaagctccctccagcttgccaacatggcaggataccatcaccaggccactggccaggactcatttagcactgggcctgaggagacttgtacacagctggccttcagacagcatatggtcaaaaaggagaggcagtgaagctccagcgagcctggcacaggccta

SEQ ID NO: 393374 - DNA, 446 bp, Homo sapiens
tgcctgagtcaggtgaacggcactgtgcctttggctattgctccttctatgatctctagccttgccagctacttcttgggtttaccctggaaggtgacatctaccaggcagccctgacatttggcgtggagaagttgctggtggcatagaagagttagaaagttccattgtctagggtagccagcattttatgttaacaagtatggccgggttgaattgggaagggtcaagcaaatcctcttccctcaacttgtatctagaccacagttttgtggaactgaacctgtgaggagggactagcagggctgtggtgggcctccagggacatgggttacctatgtgagaggtcatccctgcactgtgctctagagggcgacattcgtgctggactccaggtgaatgcagttcctgtaggcatgcgtggtggccctggtctggtgcctggg

SEQ ID NO: 393375 - DNA, 371 bp, Homo sapiens
cctcccaaagtgttggggttacaggtgtgaaccactgcgcctggccttttatttttatttttacagagacaaagtctcactatgttgcccaggctggtcttgaacttctgagctcaagtgattttcccatctcggccctaggattacaggcgtgagcctccagccctggctattctaaatgatttctgacagattttgccatgaggtggtccagagtacaacaatggtctgcagtagaatagtctgcttgttcttttttcttttttactttttgtgctctacatgttcagagaaactgaactaaagaaatgatccctaaaggaagtatagtcttgtctgctgttttttgtgttgctttgtttgttttgttt

SEQ ID NO: 393376 - DNA, 731 bp, Homo sapiens
catcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcc

SEQ ID NO: 393377 - DNA, 283 bp, Homo sapiens
atgcagaccttgagctccaatttgggctccagatggaggagggaggaccagcccggggcaggagcatgaggcgcagagggcccccagtctgcctgtccctgggaagacgtctgtttattattcgcaaagtcttaagctctggtttgttaagctttgccatgctgggtgctgtggaatccactgggaataaggcccaggggaggtttattctactctggcaagtggctatcacaaagctgtctttgggttatagaggggaggagtgctgtttcctcccagcagc

SEQ ID NO: 393378 - DNA, 144 bp, Homo sapiens
aaaagagaagaaaaagtttatcagccttaatagtaaatgcttcggataattttctaggcatttttagggcttttttggtgtttttaacacctcagtatttatggcataatgaaatgtcattgatacaaaaataatgacctggtt

SEQ ID NO: 393379 - DNA, 190 bp, Homo sapiens
ctagactgtttaagggactgccttcctcttatctctgatctgaactcaggaaaggagcaaggaagctcttgagtgccatggcagcagcatgggggcaggaggtgagccagccagaggagaagggcagctgaatgacccaagcctctgcaccagtcagccagagagatgaagggcttgaagaagccgtgag

SEQ ID NO: 393380 - DNA, 2149 bp, Homo sapiens
cgagagagagagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccagctgggcatggtggcgcatgcctgtaatcctagctattcgggagggttaaacaggagaatcacttgaacccgggaggcggaggttatggagagccaaaatcgcaccactgcaccccagcctgggcaacaagagtaaaactccgtctca

SEQ ID NO: 393381 - DNA, 2340 bp, Homo sapiens
cgagagagagagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccaggtgagcaaggctggggaacaatggaggcggagccccgcgactgcccagctcactgcccccagtgtccaggctgtggtgcaggcgtggggacccaggtgtgttcaggggtctccttcagggaaggagaccaagctgggagtctggggaggctgaggtgtgaggtgacagcaggtgaagagtgagccacaatcagcattttcacatgaaaggaaactacaggcctgggcgcagtggctcacgcctgtaatcccggcactgtgggaggctgaggtgggaggatcacctgaggtcgggagttcgagaccagcctgaccaacatggagaaaccccatttctac

SEQ ID NO: 393382 - DNA, 523 bp, Homo sapiens
agcggggaacagagacagttaggatcgaaagtaaggacaggctcctgaccattaaattattttcctcgacatattttcgggggagcgtatagagtaatgtgtggttaaagaatgaactttaaaactttaatacctcatttacctttagtatgaattcatctaaattagctgtcaaaatacacaaaatggttgctttgatttagactaacttaaaagtccaaaaacaatgtgacaaatgggcaaagtcatctggcttctattacctatttcttcagtttttctttttttcttttcttttttttttttttttttttttgagttgtagtctcgctctgtcacccaggctggagtgaaatggcacgatctcagcagctcagtgcaacctctgactcctgggttcaagcaattctcctgcctcagcctcccaagtagctgggattataggcacctgccaccatgtctggctaatttttgtatttttagtagagacggggtttcaccatattggccaggctggtctcaa

SEQ ID NO: 393383 - DNA, 303 bp, Homo sapiens
gtggcatcttggcatagtgaactttaatgtgggaccatagttcacaaactgtgaccttaggccagttaatccttctgacccttgctttccctgttgatgaaatggaagtaacactacctactcgtagggctgtcaggaggtcaaatgtgtcaacgtctataaaatgccttagccaagtggttggcacatagatagtaagtgttccacaaatgttcatttccctgtagttttactaaccattttggtgcaatattatattctttataaagtcttgtgttttggccttttttttttttttttttt

SEQ ID NO: 393384 - DNA, 428 bp, Homo sapiens
gctgtaatgacaaataagataaaatcattctaatggtcacatacgtatataattctctaaagtgtacttcttccatatcacatttatggaattattgcagtagactcaatgctcataagaagacagctaaatacttcctctcccattgataatatgtgacctcagaatagtgacttaaccatttaggaatccatattccaccaaccgaaaaatagtatagtcattaattgatatctaaagacttctgctagaaaataaacgttgtcccataataacactgattttgtatatccagtgtttttgttgaaggattgtttttatcacctacattaattgtcctccgtccctctgtcctggcctctctatttacattattatgcttggttgttactcctaccaaatgagccaagtgggagggaagtagacca

SEQ ID NO: 393385 - DNA, 802 bp, Homo sapiens
ccagcatcctttgaagcatgagttcccacaagcagaagcagccctttacctcaccccctcagcttcaacagcagcaggtgaaacagcacagccagcctctcccttaggaaccatttgttcccataaccaaggagccatgctacccaaaacttggaacctggaacctggaaacaccaagattccagagttaggctgcaccaagatccctgagccaggctgcaccaaggtccttgagtcaatctccaccaaggtaccagagccacatccttcaacagtcacttccggcccagctcagcagaagtccaagtagaagtaatgtggtgcacagacaagcccttgagaagctgaccaccagatgctggacacactcttcctatctgcttctgtatcttaattgtctgtagacctaattgggctgatttgcctgctgctgctaggaggaggcctagtagtggggtgaggcttggattagcgtttagaagggctatttgttgtgggtctcatgagttggagtgtaggataaatcatgctaaggcgaggatgaaaccgatatcgccgatacggttgtataggattgcttgaatggctgctgtgttgcatctgctcgggcgtatatcaactgatgagcagaaggatatattcctacgcctctcaaccatgaacattggattagttgtagcggaactagaatatttggtatttggagatgagtgatattaagaccgataatgttgggtcgatttatatatacagggaatcttgatggcctggacgacatgctcaggataattttggaaaatct

SEQ ID NO: 393386 - DNA, 719 bp, Homo sapiens
ctaaacagctggaagaatagatttgtcattaactgagatgtaaatgctgctggagggcaggttttgtgggaaagtgctggagttcagtttcaggtgtccatcagccatctaagtgggaatgttgaataggtaagtgacatttttgagtctagagactcttagagtcataggatactaaggagaaagttctaggcagaaaatgtaattagggagaagaagaaaaggaagaagattgacctatgagagaagaggaaaatctagagaggatggtgtactggaaaaccaagtatggaaattcttcataggagaaaggaaacatcaagtatgtcaaatgctgcagataggtcaataagaagaggactaagaacttctctttggatttagtaatttggagatgattggtcacctcaacagaaactttttagtagaccgatgagataaaagccagttgagtgggtttgtgaatgggaagaaaataatttgtagacagtgagtttgaataatctttatgagttacactgcagtaggaagaagtaactggggaagtaactggtgaagggaatggagtcaagaagtttatttaagacaggagaaataagatttacatgctgaaggggaaaattcattagaaaaaatttgtcagtttcttatttaataaatagcatttgttatgtgccagcactattcgaaatgtcactgaaacacagactcagccactc

SEQ ID NO: 393387 - DNA, 309 bp, Homo sapiens
tgatgtggacctttacaagtggcatttccataaaatcaggaacaaggggccaaagtgaaatttttggttacttgagaccatctggtggtaaagataactcattaatggtgagttataactcattaatggtgagctcagctgccagggtccactcctgggttcagatgtcatcatccttccttgacccgcccttggaggaagacttaccattcttccattcaccacttgccactgcaacatctcttgctcttgttgtcagtgaggagtcctaaatttgcaaaatcccctttctgttgttataagccattg

SEQ ID NO: 393388 - DNA, 350 bp, Homo sapiens
aaaatatgggaggagtcggaaggggggtgagggaagagaagatggttagggagagggacaggggacctggaaggagttgatgagaagaaaggaggaattgggggaaatgggaggaaatggtgggagagatgggaaggagagatgggattggaaagtgaagatggagaaggggacagacagaaagaggtcaggtgtggtggctcacgtgtttgtttgttttgagggttttttgtttgtttgtttggttggtttctgacagagtctcattctgtcggccaggctggagtacagtggtgtgatctcggttcactgcaacctccgtctccccgggatacaggggtaccgagctc

SEQ ID NO: 393389 - DNA, 182 bp, Homo sapiens
tcagaggggttaagtaactcatctagttacaatccacaattgtaacttgcctggagttatagaagtggatccaagattcaaacccaggcaatctgattcagaatctatgcccccaaacatattaattaaatttactctgaaagaaaaccatttttcctccacaaactttatacaatggaaag

SEQ ID NO: 393390 - DNA, 293 bp, Homo sapiens
gtgagaagccaggtatggtgactgctgctggatgaagcttgtcccaccagaggctcgcttgtttcattgagcacctactgtgtgcttgtgggatgcaaacacacgtgtggtccctgccctcaggttaataggcaggggtggaacagttatgaaactgctctaaagtcattttctcaaactgggagtgacaaatgtatccacttggaaaagattgagaattttataagatttttaaatttttgtttattcacattgaggagaatctaaattcttttgaacttatgtatagattt

SEQ ID NO: 393391 - DNA, 366 bp, Homo sapiens
agaaaaagtgggctcttctgaggaggtaagtggccaggaatcaaaaagggggctaggtcacgtgacaagtgtcaagaattcaaaaagaaggaatcaaggcaacggaacagtaaaactggcaggatgcaaaaggcaaattttggtgttctgataaaagtggacatacatggctaagaaattatcaagagttataaaaagaaaaaaccacaagtttaaaaaatctttacacttgaggctcttttggggaacaagtcttggaaatcaccagtagtgctaattctgcctaacttcacggatgttagatctgatgctgatatgtaggctaaagtcagataaattcacttcttagaccaacaagcaccattc

SEQ ID NO: 393392 - DNA, 376 bp, Homo sapiens
tgacggtggtcatacccaaggcaggagtgtggcaagtgtgttctagaaacatcaaggagtccaaggtggatggagtggagtgaagaggaagaagagaagagactgtgtgggagaaatgggggctagatggtttaggaccttggaggccactgaaaggatgcttttgagtagaggagtgatagggtctacctatgtttagatagccagaatccaaccagctatcccaacttctaccactggatattaagtagaaagaccagacagaaggctacggcagtgccctcaattctaagaggtttggtcttccaacttccactccttgttccccttcaatctattctccacatagcatttagggattctattaaaacataag

SEQ ID NO: 393393 - DNA, 582 bp, Homo sapiens
attgccacatgcaggggccacttctccaggcttggcttttttgcagctcagaggcacagggtctccctgccttctctaacaacacaggcacctgctttcccttctctctctctccctggatgccccctgagccttctctgcaggcttgccccctgctagacctttccaccaaaacctctctccaccaaagcctctctccaccaaggctctctttccctcctctttttcccactctgcatgtttctctttgggccacttttcccaatggcttctgtcaccacctctcttctgctgacacccaaatctccttctagctcacaggtctctcctgagctccagcatcagcatctaactcatttctacatgggggcccacaaatatcaaaaactaaatacgtcccaagcagagctcagcaccttctcccaaatacccacctcccttgtcccagtgacgggtccacccttgtgcccaagactaagctcaaaatgcctctttgtcttttcttccctctctcagcaccctctcccctcccatcatagctaattgatgtccaagtcctaccagaatctcttcatttcctct

SEQ ID NO: 393394 - DNA, 585 bp, Homo sapiens
gagacactctaagtatattatcagtgatctccagagaaacagaaccaataatagatagatgatagacagatagatagatgatagatagatagatagatagatagatagatagatagatagatagaggtctagatacacaagcagagatttattatgatacttggcctacacgattatggaagcctagaagtcccataatatgctgtctgcaagccagagacccaggaaagccggtggtgtaattcagtctgagtctgaaagcctgagaaccaggagaagacagatgtcccaactcaagaacagagatggaaaatttgcacttcctttttgttctgttcatgctctcatcagattggatgacgcctgcctacattggtgagtgtggatcttctttactcaatttactgattcaaatgctaatctcacccagctatggtctcacagaaatagtgttttaccagctatctgggcatctcttagcccagtcaagttgcacgggaaattaaccatcacaccaagtataggttggtgcaaaagtaattgtggtttttgccattaaaagtaaggcatcacaatagtgagttc

SEQ ID NO: 393395 - DNA, 425 bp, Homo sapiens
caagttctatcatacattcaagggacaaagaaggggaaactaaaatggatggtggaagaggatgatatgggtatttgttagatttctggaccaactgcagcagcaagggttgtaatttgtctcactaatcttcctcttataagttttcccaggatttgtgactaaccagaatcctggagaagctgtacctggatacagtgaacttaatataagaagcaagcctatctgtatggtacaagaagtggactgtggagaatactactggttccatccagatcatctttactggttagcacacctgtcactgagatgtggtgtcagctgagaacaactcacagatgtccctttctccagaaaactgcaactgccccctcaccaggctgtgcctctcctcccccaatccagctttcctcatactcctcttc

SEQ ID NO: 393396 - DNA, 724 bp, Homo sapiens
tgaagtctagggtgatcattctgatgctcctgaggcttagtttatacgagcctcgatatgcgttagacttctatctctatactattatcaccagtgagccaccaatgtgaggtgggtgggaagcagggcatggccagggagctgaatgacatcatctaaaatggccaccgcagccacaagctctgctgcaaggccccaggtcctcttcagtgttgatggctgttgccagggtatgactctggttcacagccctggagctcatgccgcccaagtcccggttacttgcccaaacatgggttctaccaagacataaatgccttttccagtgcagacaggccaactccctgttcttaaatattgctacttttcaggattcccatagttctcagaagagctagatttttacagccactatcaggggaaccttatgccagtgtcaaaaccattctgcaaggtcagttgtccaccctactaggtcttacatgtcagtataggatatgttcgtgtatgaataatctaccactcaaagacaacatctggaatggtggcccatccctgtgctaggggaagcctcagagagacatctggggcattagggcaacagaaattccagaaaccaccacagaaacattccccatacacgtgtctagaccatatgttctaaccctttttttaagttacagaccttttaagaatctgctgaagtattgtgagttttttcccc

SEQ ID NO: 393397 - DNA, 128 bp, Homo sapiens
ttatgatcatgttttaatagaactggcaaggagttgcctaggtactctatgacagagctggtcatgcagctttgggagagctggatatagaccttagggaattaaccattcagacagcaacaccttct

SEQ ID NO: 393398 - DNA, 743 bp, Homo sapiens
gtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactc

SEQ ID NO: 393399 - DNA, 528 bp, Homo sapiens
gcctggtagaatctcacaggtgtaggaaaatctagctgcctagggttataaaggatgccctttgtcctcaactcctttgacaccttctctctggagacctgctgaataaggaagggagtaaccacaaggaaaaaaaaaaaaaaggcaacaaaaaccaactggtgtaatttaaaccccttcaaagttaccaggctgctggagattagcatagagaaaatatgtcggggtccactttgatttgcaatttgagataaatgcgggaaacgtgtttgtgcttcctcggagaggattatgttgccttgcaagttgggttgttgtcacttttgattttagaatacttacttgtgcctccagtaatgaacaaaaaccaaaccacactgaaaccagcccgggggggtcctgctgtctcagaagctcaaggtattcctgtttctactgaattgctatttccagattcctgcctgtcacccgccagacttttaagggttctacgcttgggctgcatcgacgctggtagtttatttcaga

SEQ ID NO: 393400 - DNA, 444 bp, Homo sapiens
gcctcaagcctcctcctcagtcatcagtggagtcccacatcccccagcaacaagcctgctgcagcttcctttccaccctcagtcactggcagggagcagccatgtgaggcatggaggcacgggtggccttggtacaaatgcagctgtagattccacagcatagtggtggggccaggagttaattatgttccctgcaactgaagatgtgaggtgccattctcattgtgtcagcagggcagagagtgaggtaaacatgcagattatagagagaagactgatctttgggaatgaaaatgatgaagaggtaggaagaatggagtttgtaggctgggcgcaatggttcacatctgtaatcccagcactttggaggcctaggtaggagaatcgcttgagcccaggaattccagaccagcctgagcaacatagtgagacgtcatctctgca

SEQ ID NO: 393401 - DNA, 309 bp, Homo sapiens
ccatgttgcccaggctggtctccatctcctgagctgaagcaatctgccaacctcggcctcccaatgtactgggattacaggtgtgaaccacatcaccgtctcaatcaccgtctcaattttttgttttgttttgctttttgtttttttttttttttttgagatggagtctcgctctgtcacccagactggagtgcagtggcacaatctcggctcactgccacctttgcctcctgggttcaagtgattctcctgcctcagccttccagatagctgggattatagctttgcaccacaacacctggctaattt

SEQ ID NO: 393402 - DNA, 171 bp, Homo sapiens
gcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcct

SEQ ID NO: 393403 - DNA, 135 bp, Homo sapiens
aaaagtgatgttataaaatataaatgtttaagctgtatccggcatatagtcatatatgtcacgattgagcagagagtaactggtccaggaaaagtctgtctgtcagtgctggtgcacagcaagagctccctgagg

SEQ ID NO: 393404 - DNA, 378 bp, Homo sapiens
gctggtcaaccccatcttaaggaccagtcggggacggaatgcctggaaggccctatgagtgccccggcggcgcggggctgagccggtccccgagccgataactgagggtggggtggggactgcggtgctcgtctccgcggccggggagagcagggccgatccttttccccaagatcagagagctacctggtccccacgcccttccaacccaagaatacttttcttgctaagtcaccgagggaggagggcgatcccttcttggggagggccgcggggcgggggtcgcagaggcgccggcagcccccaaagccgggcccgggaggagaggagcgagggcagcgccctccccggacagtccccctcctccgggtctctcac

SEQ ID NO: 393405 - DNA, 421 bp, Homo sapiens
ttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacag

SEQ ID NO: 393406 - DNA, 400 bp, Homo sapiens
tgataggggagaatgcaaaggtgtaagggtatttgtcccaaaacatgagcgtgatgagaaagctaaagttgtaaagcagatgtcctgactattcttagtgatttcatagtgttattttgtgttacactgtctattttaagttccgagctggaatttacaaagcaagacaaaactagggtagaactaaagagggtttcttgaaggtgagtggtaagtactttggtgatgtaaaggaagaaagaaagatgagtaggaaggcttacagacgggttttgaagtggaatagaacttgccgttttgtttatggcccgaaatcatcctttctctttaagcatattaaaaccattctacattatacttagccattttcctgctgaacgttttactcctaataccactg

SEQ ID NO: 393407 - DNA, 428 bp, Homo sapiens
aaaaggcacatcttacatgatagcaggcaaagagagaatgagagccaagtgaaaggggtttccccttataaagtcatcagatctcgtgggacttattcatggccacaagaacagtatggggaaaccgtccccatgattcaattatctcccactgggcccctcccacaacacgtgggaattatgggagctataattcaagatgagatttgggtggggacacagctgaaccatatcagagccttgggaagtgattaggtcctgaggatgaagccctcatgaaagaaattagcacccttataaaagaggccccagcaagcgcgttggccacttctactatgtaagagtacagagaaaaatcatctttgagggaaccagaaggctggccttcaccagacatcaaatctgccagtggcttcatcctagacttc

SEQ ID NO: 393408 - DNA, 212 bp, Homo sapiens
tggctcacgcctgtaatcccagcactttgggaggccgaggcgggcggatcacgaggtcaggagatcgagaccatcctggctaacatggcatgagccactgtgcctggcctatagagctctttttaaaaaacctttcaaatatcttatcagagtatagcctgcacaaacagaaagtaggcctcccatccaatttgtctggttttagaacaaac

SEQ ID NO: 393409 - DNA, 460 bp, Homo sapiens
tgcctgaagtcaaccaggtatttctatcattagactgcctggagtcaaacgggagtcactttcagtagaatgcctgggatagcccaagtgtctctgtaattagactgtctggtgtcggtcaggagtctctcctgttagaatgtctgggatcacccgggtgtctctatccttaaatttccttgggtcagtcaggattctctccaattaaaatgcctgtggtcagccattagcctctcccattagaatgcctgtagttgcccagttgtcactatcagactgcctagaatctctccaatcagaatactgggttcgcccaagtttctctatcattagactgtctgttgtcagccaggagtctctcccattagaatgcctggggtggcccaggtatctctatcattagaatgcctgtggtaggacgggaatctcttccattagaatgtcttgggacttccaggtg

SEQ ID NO: 393410 - DNA, 420 bp, Homo sapiens
tggtgtcatggctactagggagggttaggcgagaataagtcccagagaatggaatgccaggatgccttgatggggtgccacagctgcagagagggttggggcaatggggaaaattaaggggcaatggggaaattagagaactagagatggcagcagaggctgtaaaaagacgatatagatacatgttaaattttgcctaattcccaaatttccttcaggatggccatagccaagagagccaaaaattacttgtcatggcatgaaaaggtgctgcttatttcagcagggagaaaaggcctagtgtcaacggctgagcatccttcttcagcacatctgtaggctgatcttcatctgctaggatgccataaaacctcccaggaggctcttggtgctctcttcttgaccacagattgataactc

SEQ ID NO: 393411 - DNA, 233 bp, Homo sapiens
  misc_feature (15)..(15): n is a, c, g, or t
tcaggactccacttncagagtagctgtgggatgagtgatatttggctgtgccagtgggtaatttgccaatgtgtattcctgtttcatttcatgcttatttgtcaaaatcagcccaactgaattgtgggaaaagttgattactatttacctcaagcaattgggatgagtcctgcttcagggccaactccaggaagcttctgacctcacctaaataagtcctctactctggaaag

SEQ ID NO: 393412 - DNA, 372 bp, Homo sapiens
caaccctgcctagacaggatgaaaagcaagaacccaagccagagatgagcatgagccatacacactggtgcctgatgagttctaagtaggggctatgcaacgggcagtagagagagagagattaatcaccagagagtggaaggccttcttgctgaacaatctctgtgggatgagtgatatttggctgtgccagtgggtaatttgccaatgtgtattcctgtttcatttcatgcttatttgtcaaaatcagcccaactgaattgtgggaaaagttgattactatttacctcaagcaattgggatgagtcctgcttcagggccaactccaggaagcttctgacctcacctaaataagtcctctactctggaaag

SEQ ID NO: 393413 - DNA, 292 bp, Homo sapiens
cacacaagaaagcccagatacaatcatgttcctatcttcagaaacaagaatttctctctctatctcagaaacaaggatttctctctctcacacacacattctctctgtctctttctccttatatgcaagaaagaaatggagaaaaatggccaatccatctatattttattttagttacattcaacaaactaggtctcacatttttagacattctgaaaatgtcagaccataccccagcacagcgtaatagtgccatggaaacaaaagaaaaccaattcctttgtcattcttt

SEQ ID NO: 393414 - DNA, 502 bp, Homo sapiens
tgagagtcttaacatcagtggtaaaagctttaatatcatatgttctataattacacaaagaaagaaataataaatgtactgaaaacagtgactcactagccataatgaaagaccttttattgcatatatagtgctttgagaaaataaaatgtatgaaaagctagaaatagattgtagaagtctgtgattaaacagaagaatgtgattagggatttatcaagtttattgatgggaaatttacataaagtaaatttttcactctttgggtgtgtagttataaaaaattttgtacacaatcaattcagatgtacgcagttaattcaaagtgtacagtaatgggtccaccactacaatcaaatgtaaaccattccgtaatgcaaaaaagttccctcaggcctttttataattacctccctagcccataaccaaaccttagcatccactatagattttttcttttctagaatgtcatataaatggaatcatatagtatgtgtagtct

SEQ ID NO: 393415 - DNA, 538 bp, Homo sapiens
gattacagtggcttgagtgtcatgtgtgaaccaaaggagagtagtggggtggggaatgctgctaaggaagaggggagaaagggggcaactggtccttggatgtagtccataaggaaggtcctcagctggaaatcacatcctgaatataccctctttcatccaggattattttcattcaaaactggaaaccacaaattgtggtttctacaaagactatttcagaagtacctcttctgatggctgtgagtatggtaaccatttgtattcctttcctatgacagtccctcaattataccagaatccctgttgttctggtgcatttattcagagcacccatctttactcttaaaagggtactggtttggaccatatggtatggccatcctagctctgacttaacaatgtgattattccttttcccctaaatagatattgttcagattaatacattctaaaaggtaggtcatttggcatgtgatcttcattctacctttaatagctgtctgttccatggcacgccactttagtctaaactttc

SEQ ID NO: 393416 - DNA, 477 bp, Homo sapiens
tcaggtccaggggacgatgtgtgtggccaccccctgcaaacggtggtcctcggtcctctggtgcctcctgctccttgtacccgcaccctgctccatcagggaagaagacacttttgaacatacttctgcaggcccatgtttggtaaatcaagtcacaagattattgactatcagagctagtcagaggagggtccatggagaccctgtcgcccagctctctgtttacagagtaagacaccgaaccaggggtggggggtagcagaagccacaatccaggcccctatatcctgttaataggatatcatcacatcaatccacctgcccaggtcacaccatgtagtggattgcaacaggggagtttgctagagtgatacacaaaatattaaagaacccaggcacagaccagacacagtgcatgcaggtggtagtagggaatggggccccagaggttccctcctgagccagagattaaccgtt

SEQ ID NO: 393417 - DNA, 4637 bp, Homo sapiens
  misc_feature (3640)..(3640): n is a, c, g, or t
  misc_feature (3659)..(3659): n is a, c, g, or t
  misc_feature (3662)..(3662): n is a, c, g, or t
  misc_feature (3665)..(3665): n is a, c, g, or t
  misc_feature (3667)..(3667): n is a, c, g, or t
  misc_feature (3669)..(3669): n is a, c, g, or t
  misc_feature (3672)..(3673): n is a, c, g, or t
  misc_feature (3677)..(3677): n is a, c, g, or t
  misc_feature (3682)..(3682): n is a, c, g, or t
  misc_feature (3687)..(3687): n is a, c, g, or t
agttgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttctgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtcaaagtaccaagataaaaaaagtttcctataactggagttttaaggtatttgtgttagcaaatgttttaaatccatttcatcaaagtattaatgatttcaacacgtcatcatgagaactggtagcactggacataagtgaagagattagatattttatatacatatatatttttatacaattatgtacattaagccaggcacggtggctcatgcctgtaatcccagcactttgggaggctgaggcaggtggatcaccagaggccaggagtttgagaccagcctgaccaacatggtgaaaccccatctctactaaaaatgcaaaaattatatgggtgtggtagcacatgcctgtaatctcagctactcaggaggctgaggcaggagaatcgcttgaacccgggaggcggaggttgcagtgagctgagattgcaccattgcactccatcctgggtggcagagngagactccgtctccaaaanaanaanananaannaaanaaaanaaaanaaaataaaataaaataaaataaaataaaataaagcacactcagttaaatatgaatgtcagataagtaccaaataacttgtgagtataaatgtatcccaaatatggaatggaatacacatagtaaacatttttttttattatctcaaattcaaatgacactcagcatcttgaatttaatctgacaactccacctcctcctaccctctttgccccttgtcaggcaagctcaatagctaggccgagagctgctgagggcggggaccttgtctgtctaggccactgctgtatgcgtgcctggccctcagcagggaacctgacatgaagcacacgctggataaataaatacctgttgctggagcgagtgatgggttcccagccctcactggggaatcgaggggactccacctcagcccagccagatggaatcgtcgggaacagagtgcaccttaatttctgcgaagaccaatgcaaattagaagaagactgagatgcaggctgtttgatccaagagatgctttttaattattgtaaaacagctgtgacttactgagcaccaactgtgtacccggcctcacactgttctcatacacaacagctccacggggaaggcattctcaccgagattcagagaggggcagacctggcctcgggtcgcacagctgggaaccggacaccgggctctctccagtcagctcgggtgctgctggccccagcacctcccccatggcgtggaccagggcctccgaggctgctttaaagaaggttctttgagaacggcgcatgtaccgtgtggacactcgtgtgcgcccctgaagtttttgagccagccaccctgtcatcaatcttggttatgcagttcatttattcagtagaccccaggttcccatccacgtttggtgcacaggagaactcccctgctcaggaattctgaattaaggaggctttgaatg

SEQ ID NO: 393418 - DNA, 348 bp, Homo sapiens
aaacctgaacttagcagcatgtttagcagtgtgtttagagttcttggaggatgaataaaaatggaacccataaaatggacacataataatagtctggccaggtagaagtgcttgagagcactttgaacacttgtctcctttccttgtctgtaaactgtctgaacctattttatagcatttagtcttcacaccatatttttcctgccaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattat

SEQ ID NO: 393419 - DNA, 4443 bp, Homo sapiens
  misc_feature (3446)..(3446): n is a, c, g, or t
  misc_feature (3465)..(3465): n is a, c, g, or t
  misc_feature (3468)..(3468): n is a, c, g, or t
  misc_feature (3471)..(3471): n is a, c, g, or t
  misc_feature (3473)..(3473): n is a, c, g, or t
  misc_feature (3475)..(3475): n is a, c, g, or t
  misc_feature (3478)..(3479): n is a, c, g, or t
  misc_feature (3483)..(3483): n is a, c, g, or t
  misc_feature (3488)..(3488): n is a, c, g, or t
  misc_feature (3493)..(3493): n is a, c, g, or t
agttgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttctgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccacagggtctggtggttcagtagaaggactcctgcagaaggtgctggataaacactggaagatctagaaataaaaataaaagaaagactgggcacggtggctcatgcctgtaatcccagcactttgggaggctgaggcaggtggatcaccagaggccaggagtttgagaccagcctgaccaacatggtgaaaccccatctctactaaaaatgcaaaaattatatgggtgtggtagcacatgcctgtaatctcagctactcaggaggctgaggcaggagaatcgcttgaacccgggaggcggaggttgcagtgagctgagattgcaccattgcactccatcctgggtggcagagngagactccgtctccaaaanaanaanananaannaaanaaaanaaaanaaaataaaataaaataaaataaaataaaataaagcacactcagttaaatatgaatgtcagataagtaccaaataacttgtgagtataaatgtatcccaaatatggaatggaatacacatagtaaacatttttttttattatctcaaattcaaatgacactcagcatcttgaatttaatctgacaactccacctcctcctaccctctttgccccttgtcaggcaagctcaatagctaggccgagagctgctgagggcggggaccttgtctgtctaggccactgctgtatgcgtgcctggccctcagcagggaacctgacatgaagcacacgctggataaataaatacctgttgctggagcgagtgatgggttcccagccctcactggggaatcgaggggactccacctcagcccagccagatggaatcgtcgggaacagagtgcaccttaatttctgcgaagaccaatgcaaattagaagaagactgagatgcaggctgtttgatccaagagatgctttttaattattgtaaaacagctgtgacttactgagcaccaactgtgtacccggcctcacactgttctcatacacaacagctccacggggaaggcattctcaccgagattcagagaggggcagacctggcctcgggtcgcacagctgggaaccggacaccgggctctctccagtcagctcgggtgctgctggccccagcacctcccccatggcgtggaccagggcctccgaggctgctttaaagaaggttctttgagaacggcgcatgtaccgtgtggacactcgtgtgcgcccctgaagtttttgagccagccaccctgtcatcaatcttggttatgcagttcatttattcagtagaccccaggttcccatccacgtttggtgcacaggagaactcccctgctcaggaattctgaattaaggaggctttgaatg

SEQ ID NO: 393420 - DNA, 380 bp, Homo sapiens
agttgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcggtgaggaaggcgtctgcccgggggatggggttggagggtccaaagtagcgcttcccattctggctttgccctgagcaaggcacccagtcgtgctaacagatttagcttatcagtggtctagctgcttcatcctaccaagggtaaaattatgactataataatagc

SEQ ID NO: 393421 - DNA, 205 bp, Homo sapiens
ggtaaggttgtgcagagatttgggatttgggctcaatcagactctaagcctctctcaatttctagccttcgatgtccgcttttatagtaaatatttgttgaattgattagtacttggtaaacttgtgcttgaacttcatttacagattatgttgcacaaaacacttgtggctgtagcctcctttccagtgctatatgtgaccctt

SEQ ID NO: 393422 - DNA, 130 bp, Homo sapiens
attttaagtcgttttatgctttaaaaatatttatatttaatataaacaaaagaaacttacttttaaaactcttagataaatttttctgctgcttgcagtttttcacttggctagtgtggaaaatgaaaaa

SEQ ID NO: 393423 - DNA, 576 bp, Homo sapiens
aagagccaacatctattcagagattgaaacttaatgatcctttaatatctttgctggatgttgttagaatggtatttcaaacattttctacaatttgaattaaatattaccttactaaataacgcgaggctgggcaaaaaaaaatgttaagcataactccaaatatagcataacagtttaatgctctgtttgttgccttaacaaaaaatgaatgtctgcaacacattcacaaaccacctggagattcgaactcacagtgaaagtgcaatgacatattgtgctacttgacattagctattaccaaagacggttcaaaaggaagagaacacagacaatcttattagtataattggaaatgtgctgatatacccaccttaccaaacatcttctcttgcagtgtattatattacctgagaaaagtaacttacaatcagtgctaatatgctccttaacctgatttacaagggcaactagcaataaacagaacaaggcccgtgaactaccacacaggtgacttcaattctgtatatctggactggatgggaatacgggggcttacatgtttgtggccttctt

SEQ ID NO: 393424 - DNA, 105 bp, Homo sapiens
tctggatatattttgatgagaatatgagaaagtagccacaaatcacaccgtgcaccatgaaatttgcaacagaaatttcatagccaaatatatttaagtgttctt

SEQ ID NO: 393425 - DNA, 197 bp, Homo sapiens
tccactgcgggtgttgctgaaccccactgggactctagagccaatgtcaatcatactccttggagtcatcccacccaaggggccagagaactggggtattcatgcaccaatttccaccaggctgtggccgaggttgtgcccaggggtcttccgctttctagcttttctggcttgctgcatgcgtgggcaaagtgggc

SEQ ID NO: 393426 - DNA, 505 bp, Homo sapiens
gtcttttcggagttttgatagctttatcctttagtttctgggctggttcctctgcccgagcagctctgaggacatggggctgttggtgtgtttgattctgaggcgtgcccatgaaggctgctgctctcggaggtgttctgagagggtctctgatgggagtgagacactctctcctgggctgggcagtcgatgaagttggaggggctggacaggaggggctttctggactggaattcactgaatgtggccaagtacagtttggcaaaaacccaggcggctgagtaccttgcctcttaggagttcttggtgtcttcgtttcaagagaggtaccttctcctgcctgggtatgtcgtttttgaggagtgatttttgaatccaatggtgagtcatggccgggtgaggaggagtcttttaaggactccttaaaagctgcctgctttgtaggggtcatttttgcaggggacttctgcagcctttctggagtatacaacggagtttgtggtgt

SEQ ID NO: 393427 - DNA, 444 bp, Homo sapiens
cgagtctcattggtgcccttgacaagagcagtctctgtggaatggtagaggcagaaacatgactgaaatggattagaaagagaataggaagagaaaaattgttcggttgactttttagaccactctttaaaagattttgctataaagaagtgagacaggctgggcgcagtgactcatgcctgtaatcgtaacactttgggaggccgaggtgggtggatcacttgaaaccaggtgtttgaaaccagcctgggcaatgtagcagcaccccgtctctacaaaaaatacaaaaattaactgggcatggtggtatgcacctgtagtcccagctacttgggaggctgaggtgggacaatggcttgagcctgggaggtcaaggctgcagtgagccaagatcacgccactgcatcccagcctgaatggcagagtgagacgctgtcaaaaaaa

SEQ ID NO: 393428 - DNA, 349 bp, Homo sapiens
cttctgcggtcgctctagaggactccccggagtagaaatgggagaagaggcagatgttgagggtgagagagttgcagatccaggcctgggtgggccatggggatggtggcaccaggccccaacaccctgggctctgccctgcagaatcgccagcccaggctgaggcaggatggctgggctctggtacttaagcaaatacatggaaatttccccttggaaccaccaggaaatggggtactatttcttcatctgtggataacaagggtttaactaattaggcaccaaagtgagtattttggaaggacttatcaaacctcttagaggttattgagcataatttcacttcttt

SEQ ID NO: 393429 - DNA, 267 bp, Homo sapiens
ggcaaaggggcaaagtctgtccacagactcacaggaagggaggtgcatggcagacacaggcaggaggtggggttggggtggaaaagttcagggagggctcaaaagcagaccaaggcctgtttctgaaacccagcccactcactggttcctccacacttggcccatgctgttcctctcccatgtgacttttccatcttccccctccaacctgtcacccatccatccttcaaaacttaggtcagttagctctcacctagccctcagcag

SEQ ID NO: 393430 - DNA, 1419 bp, Homo sapiens
gacagcctccaccagagtcgcccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccctgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtgccgccggcagcatggacaaaggtctccatgcagggggaggaggcctgcttctttccccacagctctcacgtctcccttctactgcgggtgacaaagaagcccaaggaccacctccttcctgcctcattgtactgcgggtgacaaagaagcccaaggaccacctccttcctgcctcattgtaataaaattccccacactgaaaaaaaaagaa

SEQ ID NO: 393431 - DNA, 1359 bp, Homo sapiens
gacagcctccaccagagtcgcccacctttctggaagctgcagggctctccatccaggatccagaagcattgaaggggaccagccgctgaagggattctcagtcccatctgactccccatgaggctcctggctttcctgagtctgctggccttggtgctgcaggagacagggacagcttctctcccaaggaaggagaggaagaggagagaggagcagatgcccagggaaggcgattcctttgaagttctgcctctgcggaatgatgtcctgaacccagacaactatggtgaagtcattgacctgagcaactatgaggagctcacagattatggggaccaactccccgaggttaaggtgactagcctcgctcctgcaaccagcatcagtcccgccaagagcactacggctccagggacaccctcgtcaaaccccacgatgaccagacctactacagcagggctgctactgagttcccagcccaaccatggtctgcccacctgcctggtctgcgtgtgcctcggttcctctgtgtattgcgatgacattgacctagaggacattcctcctcttcctcggaggactgcctacctgtatgcacgcttcaaccgcatcagccgtatcagggccgaagacttcaaagggctgacaaagttgaagaggattgacctctccaacaacctcatttcctccatcgataatgatgccttccgcctgctacatgccctccaggacctcatcctcccagagaaccagttggaagctctgcccgtgctgcccagtggcattgagttcctggatgtccgcctaaatcggctccagagctcggggatacagcctgcagccttcagggcaatggagaagctgcagttcctttacctgtcagacaacctgctggattctatcccggggcctttgcccctgagcctgcgctctgtacacctgcagaataacctgatagagaccatgcagagagacgtcttctgtgaccccgaggagcacaaacacacccgcaggcagctggaagacatccgcctggatggcaaccccatcaacctcagcctcttccccagcgcctacttctgcctgcctcggctccccatcggccgcttcacgtagctcggagcccttccactcctcccaggtcatctcttggaccagcgggcatcacattctccagcagccgccatctcacacgcctccctcctgtgccgccggcagcatggacaaaggtctccatgcagggggaggaggcctgcttctttccccacagctctcacgtctcccttctactgcgggtgacaaagaagcccaaggaccacctccttcctgcctcattgtaataaaattccccacactgag

SEQ ID NO: 393432 - DNA, 708 bp, Homo sapiens
agacacagcaaaattacacaaatagtgcagatagtaatattgcagaagtagtattgcagaagtaatattgcagaatagtacagagagtaatattgcagaaatagtagagagaattcacttataagcttcatctcccagctcctaatgttagtaatttacataagcatagtaaaattatcaaaatcagaaaattcacactgagtaattagctaaagcacaggttttgtacaaatttcacaagtttttcccttaaccttttttttttcctgtttcaggatccaatctagggtcccacattgcatttagttgtcacatctctttactgtctcccaatctgttataggtcttcagactttcctagtctttctcaaccttgacactttttatgaggactggtcagttatcacgtcaaatgtctcccaatttagcattcaagtaggttaaggttatgcatatttggcaagaatactacagaagtaatgttctgttattctcagtgcatcatattatgggttatgatgttgatgatttttttattttgacttagttaaatgtatctttctattcactatagttagtgcttttaatgtttgaattaaagttgtttcctacctcaaggccttgatactttcctatgtattatccttcaacagctttattattttgcttttatatttagatctacaatattaaacttggtctcactaa

SEQ ID NO: 393433 - DNA, 483 bp, Homo sapiens
catatatgtaggctggaggcaggcggaagggacaaagaagtaccgtaaggccagcggttaaggtggaaggtagggaggagcaggagagagagaaggtggatgcaggcacggaaagcaatctgtaagtttgacagagatggtcagcaagagtgactctttggagcagtattgtgaatgtcaggtcaaaggatgtcggtcttctgtgtccaagttttccacccctgccatgagtgttatagctagggagaaacaacgtgtaaactcctgctatttcttacttggactattttagtgatctcttactaatggcaatgtttgccatttcttcccctgtggcaagctgtgatttcttctatttctaaccagttctttatagaactggtaggacttatgtttgatagattccttccgtatttaaaaaatttcatcgtgttccattgcctgtggaataaaacccttgcttcttgttgtggcatttgaggt

SEQ ID NO: 393434 - DNA, 191 bp, Homo sapiens
gttcaatggaggtaagtccagtccagtcccgcctgatgtcaccaaagcagtacaaggatttagggagagaatggatagggacaggcttaaagaaaagtgagtctaaaggcacgggattactcgtcccctccgccgggcacactaatgagattacccgaagcctcctgccaccgctctgccacggagccatg

SEQ ID NO: 393435 - DNA, 313 bp, Homo sapiens
agtagaggaggcatggagtcaaaagacccaagaacatctggtcatagatgcagactgatgacaactgtatatttaagatgtatatttggtcatgtttcatcataggactaaagaggaatctcaaaaccaaaatgccaaactttatgcaaaagtctgatacttgggacgaagtattttgaatactgttttctttgcttcttaagatcactgatgttgggtgctaagtatttcactatatttggggttgttttattaaaaatttaaatttagatgtatggtttcaatttcttgggattagatacatgatctgttt

SEQ ID NO: 393436 - DNA, 208 bp, Homo sapiens
aacgatggtccctcagcttccagtagctgggacataagcacacgccagcacacctgtaaccccaatatttggggaggctgagatgagaggatcacatgagctcaggagttaaagagacctgcctaggcaatatagtgagatcccgtttcaacaaataatttaaaaattatccaggtgtgctggcgtgtgcttatgtcccagctacttg

SEQ ID NO: 393437 - DNA, 337 bp, Homo sapiens
gatatgctagctgccctttccttctgccatgattgtaagcttcctgaggacctaaccagaagtagatggtggcaccttgcttcctgtacagcctgcagaaccatgggccaaaatgaatctgttttctttatacattaaccagtctcaggtattcctttatagcaatgcaaatggactgacacagaataacacatgtataatgggaatactggaaggaggagagaaaaaggaacagaagcaacatttaaagcaacaattactgagaatgtcccaaaatgaatgacagacacaaagctacagatctgcaaaactcagagaacatctaggaggataaata

SEQ ID NO: 393438 - DNA, 349 bp, Homo sapiens
tcggaaatgcctttttcgtttgattaagagttactggtttgtgagggcagtgactgagatgtcattatccgtgtttttggaagctgcagggttctgagtctagccctcaggagctcttagcatcagtgaaccttgccagcatcagcaggcccccagctcctgcccacagagcacctccctgccaggggccacagtccctagggcctccggtatcaggcggtcaggatgacagtatcctaagaaaaccctttcccctagccagtccccagcatgcagcacactgtctacctcagccatgagcctctgtccttgcgtgtgtgcagtttcttgtttagaacagacccacaag

SEQ ID NO: 393439 - DNA, 519 bp, Homo sapiens
tgagagctgggagccagggtgcagcatcttacctgagctagctgaatgggagaggaagagaggctcaatcaggactagggagagcaagtcacaggcagaggggaagttgggagtccaggggcaacagagaggagcaggtgtggggctgtgagcagggacagtgaccctggcagcctcaggccactgaagccagccctcacctcctggtgtgtaggcctggcccctgccaggctatgggaaagactcctccccatttgcatttcaggaaggctggacacaccctttgggaaacactggagacatgattgttcccagagaggctaagagcttaaggtgggcatcggggactctcaagatcaccacgcacctctgcttacctggtaacacagcaagcagcttgcccacctgctcctaaccccgagatgtgaatgggcaaggttcccagtttgaggaactctcttgggccacatccattcagcctaagaggccacagaatcatcaaaccctctacttcatcag

SEQ ID NO: 393440 - DNA, 410 bp, Homo sapiens
aagaaaatgacacagaaaaggcaaatagcagtgaatcacagaatgcctactaagtaataataaatgcagactagctctaacccaagactattcttccaaggtcagagtaattttgtatttaaaaaccaaaaccaaaaacaaaaactcttcttggatccctcacagaatggagatcacagggcaaactgctttctaaaatggagagataatctggcagatacagttgatcacagcttactagtagcagaagaccagaaacagaatccacagttgaagccactattggtaggagcaatttaaactgtaattgaccaattgctggggggtcattgagagttaaaaactccaaggacttacaggtttaagaggacctctccagtttttccaatttcaccgtctaggagcgtaat

SEQ ID NO: 393441 - DNA, 201 bp, Homo sapiens
cagtcttatgttttgttttattggtttattaattttaaggatttaaggattctttttgaactcattttaccataagaatatttacattccttttcaccaacttctgcttattcaaagatgtgaggaaattagttcactgtgctcaatcctcagctgttttcttccagcaactctgataagtccctggagaattcctttagg

SEQ ID NO: 393442 - DNA, 248 bp, Homo sapiens
atgagtggtgggaattcagatcggttgtgtgccttgtgagggcgcggcgaggtaccggcgcgcatctaggctttattaattttaaggatttaaggattctttttgaactcattttaccataagaatatttacattccttttcaccaacttctgcttattcaaagatgtgaggaaattagttcactgtgctcaatcctcagctgttttcttccagcaactctgataagtccctggagaattcctttagg

SEQ ID NO: 393443 - DNA, 259 bp, Homo sapiens
agaaacatttgaagagtggggaaactctccatctctagagttcctcctttggtatgctacaaaaggcttcaaaaaccaccttgtaaactatacggttttaaagctgaacaacttgaaatctggcaaagttaaacaatttttccaaggtgtcttattgatttaagttattaaaataaagtacaaaatcaaatacatatgatgtggcttctaaacccccaagggccagttttactctacccaatccctctattcatttaaa

SEQ ID NO: 393444 - DNA, 313 bp, Homo sapiens
cacacacacacagggggcttaaacaagttcaagtcgcagtattcattttgaaagcatgttttattactacagttcatagtcttggtagaggagaatattctatttgtatttctgaactaagggaagagaagcttattagaaattggctttttactgtggaatcaaactagatgatattaagattgaacaactggtgaacaacaacgagaaaagtatttcagcctatacagcaggttattcctcatctaggaatctttgagtctaggtgaacctggctttagggataaaatagcctttcacaagaaagataaac

SEQ ID NO: 393445 - DNA, 187 bp, Homo sapiens
accctcttgctcaataaacacagcctggcattttaaatgtcagcacatctcaattttgtgagagggtctgcctgagaggattgacttgaaactacacagcaaagaggaggtgctagtccacatttgcgtgttccatttgcatgagcaaaatggacctgaagatggagctgcagcaagaggggaggca

SEQ ID NO: 393446 - DNA, 681 bp, Homo sapiens
aaaaatataaataaaaataagtaaaaagaaatattagtaaatataaatataaatacatataaatataaaaatgcattcatgaaaagaaacaatttttaaatttaacatcactgagggcatcctatccatttcatttcatgattccattatgtcatttcacttagatgaaatgataagatgacttgagatgagatgaaatgatgagatgaaatgacaaaatgataagatgagatgatgagatgaaattttgagatgaaatggtgagtagaaatgatgagatgaaatgatgagacaaaatgacaaagttgaaaagaaattgaaaggagatgagatgaaatgagatgaaatgatgagatgatgaaatgatgagatgaaacgagatgaaatgatgagatgaaatgaaatgaaataatgaaatgatatgaaataatgaaattgaaatgagatgagatgagatgaaataatgagataaaatgagatgaaatgagatgaacgatgagatgacatgatgagatgaaatgagatgaaaaatgatgagatgaaaaatgagatgaaataatgaaatgaaataatgaaatgagatgaaatgaaatgaaataatgaaagcaaattatgaaatgtaatgaaattgaaatgaaattgaaatgagatgagttgaaatgatgagatgtaatgatgaaa

SEQ ID NO: 393447 - DNA, 512 bp, Homo sapiens
caggaataagagcagtcctcaaggctccaggagtgggagctgtagtaacacgcagtgcccagggagggacacatggcagggggtgtgcagcaggtgggcaaggcgctaatgaggggcctggagtcccaggccaagggctcagacttcctcctggggataatgggaaggagaactgtgtggccaggtttgtgcccttagtgaggtccccaagggggagcctggaaggaccactttcttcttttggcccttcggacccccagaggctctgcctcccacaccctggcctccctccccagtctctgggaggccaggcctccgcccctctcctgtgctgctccttcccccagaggactgcatccgccctcagcacttcaaggccctgcacgtgcccgcacctctccactccccaggctcagcttggacctctcttctgaactccagacttgtggatcctgctcccctcgccacttctgcacttggggtctaatggggcctcagcggaacatggagtt

SEQ ID NO: 393448 - DNA, 120 bp, Homo sapiens
ctaagattctctactcctttgagtctggggcatgctgggaaagccatcaggaatcatccaaggccaagtgtcctgaggctgtaggccctcaagcttgtgtcaagagcaaagcagggctat

SEQ ID NO: 393449 - DNA, 256 bp, Homo sapiens
taaaacccatgaagtcctaaacagtgttcacctttatgttcttaattaaatcttgtagcgttaatctccctgtctgccaaatttcctactgaaaggaatgaggcaccagatggcagggcattttctcatctactccacgcacagaaggagcagcgtgaagctatttcctttgccgggtttcactcctactctcccaaagacagtattaggagctgcaaagttggagaaaacccacagacatcatactcaaacaaac

SEQ ID NO: 393450 - DNA, 373 bp, Homo sapiens
agcgggactgcagggagtggggctgggaggtggctgtttgcacgtgtggtcagcacatccagtgagggggtccatgtactgtgggcagccccacagatggagttgggattgccctggactgagtactgggtcatcagactgcaaactgccattctcaagacatcgagtcccaggctggtgcaggagatacattgcagtgtgtcagcctttcttccatcgctcctctccaatgacagttcccgattttccaccgaggagtcactagtaccccacggcatgtgtgcgactggccactccccaccctgatctggggctggggcatgtggtcccagcctggatgtcaatatccttccaccaccctggccacagcgat

SEQ ID NO: 393451 - DNA, 395 bp, Homo sapiens
ttaataaggaaagaaaaaatatggtatgctgaggttgctaagacctacagtaaaaacgaatcttctatccacagaattgtcaaaaaggaaaaagaaattcatgcagttttagtcatctactgtgggtcttgggacttgtccccgtgggataagggagtactgtggtcttaccatacaatccagcaacctcaatctttggtaatgacctaaatgagataaaaatgtatggccacgcaaaaacctgcatatggatgttcatgacatcttcattcattattgacagaactcggaagcgacagtgatgttcttcagttcgtgaatggataaacaaacagtgatgcattcagacaatggagttagtgtttggaagaaacttttttttttttttttttttt

SEQ ID NO: 393452 - DNA, 152 bp, Homo sapiens
acattttagtggcttaacacaatctaagtttactacttgctcatgcaacactctaataaggcgaagctttctggtcaggctcctccaagcaggaagtcaagaaccaaggcttctcccagtctgtggctccgccattccccaagtcctcaaag

SEQ ID NO: 393453 - DNA, 803 bp, Homo sapiens
aatggtgaaagaccaaaaaatttccctgtacaatcaggatgaggacaatgaaacccactttcaccacttctattcaacatagtcctgaaagttacggctagagcaattaggggaaaaagggaaataaaagataaccaatttgtcggggaagaagtaaaagtatctctcttcacagatgacatatgtagaaaaccctagaattactttcacatgagcgcgcacacacacacagggctaagtaaactaaatcagcaaaaccaacacccataaatgagttgtatttctacacactagcaataagcaatctgaaaaggaaatttaaaaaacaatttcatttacagtaacaccacaaaagttaaaataggaataaattaaaccaaggaggcagaagactggtactctgaaaagtacaaaagagtgctgaaagaaatgagagaagacttgaatgaatggaaagatattctgtgttcacggatgggaaaactcgatatagttaagatgacaatactacccaatgtgatctaaaaattctgtgtaatctctatccaaatcttaatggcatttttttgcagcttagaaaaaatccattctaggccgggcgtggtggctcacgcctgtaatcccagcatttgggaggctgaggcgtgtggatcatgaggtcaggagatcaagaccatcctggctaatacactgaaaccctgtctctactaaaaatacaaaaaattagccgggcgtggtggcgggtgcctgtagtcccagctactcaggaggctgaggcaggagaatggcgtgaacctgggggg

SEQ ID NO: 393454 - DNA, 680 bp, Homo sapiens
  misc_feature (604)..(604): n is a, c, g, or t
  misc_feature (612)..(612): n is a, c, g, or t
aattatcagcctcagtgtaagatggtaaatcattgtactggcacagcagtgcatcaaaggcagtctaaagtgcttttaaagtcagtatgacactaggcaaggtctctggtgttactcacaggacagattagaaattgattgaataaccatgcctaaatgttatgtcactctggagggaattttcttttgaattctgcaggactcttttttatgttcttgtctgttaacctatttatcagatttaaacgaatatacaggaaatatttccacaaaatgcagagctgagaaaatagtgaaaatactggaaaacataatcaggaaccacaaatatctgggcagttagaaataacataaacagctaaaaattaccagtgtaaaattgttagatcctagctaaattataaaaatcacatattcttattcagatattgaagattttgtttagaagtagtccatgtgaacatgtcaaaggtaaacttggcatgtttatatataaacttagcctgagtgtgaagaattctgtaactattaaaattgcaatcttaggattaaaataataataaaaaaaaaagaaaactcgaaggggggcctgtacccaattcgncctattgngagtcgattacaattcaatggccgcgttttacacgtcgtgacttggaaacactgcgttacccaaatta

SEQ ID NO: 393455 - DNA, 396 bp, Homo sapiens
ctctttaagccacagtcttttggggatttttgttacagcagcttagcctttactttagtctatataagtggctaggctgggaccaaaccaagtcttgaacccaggtttcctgaccccaagttcagtgtcctcattctcctagccaacccttcctcatttttttttttttttttttttttttgggaaagggggtttccctttttaccccaacttgggttcccccccgggggtttttttttaaaaaaaaacacccataataggttttttgcaaaaggggccctttatttttcttttttttttccaaaaagcaaaaaaaaaatccctcttttaaaaaacgccctccttgtccgaaaggaaggtcttttttttttttttaaaattggaagtcttaacttg

SEQ ID NO: 393456 - DNA, 380 bp, Homo sapiens
tcttcagggctctcagttctaggatagcagctggggttttaccgtcctaccagctgggacccatgcctcagatagaagccccattgcctatgaaatgagaaggtatcacatgagtattccaaaatacaggcctccacttgggctctttccaaaagcaatagcgaaagggacagtttccgtccccgggccggtgagctgtattaactgttctgctcccggggtcgccatccaggcagtgacagccaccgtcgccaggcacaggccaggccaggccctgccgccccacctccatcccccttagtggatgtagatatgattgtttgcgactagcgaaccccctatagatgcagatgcctcctgagccggcatctgtgttgagt

SEQ ID NO: 393457 - DNA, 573 bp, Homo sapiens
aaggtaaatttcctttatgatgctacttggcccccagcatgatggtgcaagctggatcactggggctgctcagggaaaaggaacccagaagcctggcatgctggcaaaagggtaagaatttcttaccagtcagacttctggcttctctctctctctctggcaaacggttgtgaagtcttacagaaatggcaaaatcttacagaaatggtaaaaatcactatatttctcttctgtatagttttgattaatgcgaaaaataattctgaggctagtcttaaactgatgtatttgtgctatgaatttgtttttctgtgtcaaggggtaccttaggataaaatatgggcttaggactccataagcttgctgctcaagacagctcaacaagctggtcaataacaaactttcctgcaggtccctgaaacaaacaaaaaaactggatggggtctcatcttgttttatgtccttgggagcttgaccttgtaaccaggttgaggaactttctcttggtctccgccttccagggaatggggattttagggtttatgtcatagttagctctaaaaattatcttga

SEQ ID NO: 393458 - DNA, 400 bp, Homo sapiens
acacttgggttgctgcagtggttggggaggagggtgaggagtggtgctacagacatctaggaagaagaggacaaggatgctgccaaacatcctaaatgcacagggcatcaccccacagcaaggaatgatctagcctaaaatgtcaataatgctgaagtttcaaaaccctaatgcataggttgaaccatatgaaatgcatataatttttaataatacatattaggctgagccgtataaaactgcaaatattttggtttgtaaaaatggcagtttcatacagttcaacctaatgtaattatggatttctgaatgaactgctgtacaaataaattatttacattttaaaattcaaaaacattgcagggccaggtggctcacacctgtaatcccagcattttgg

SEQ ID NO: 393459 - DNA, 421 bp, Homo sapiens
tatagctgtaccacagacagctagagttggctaatgtagggtctctttgtgaagtaatgtggaatgagaaaagctggatagttaagtagaggctgtgtaatgttgatatttaggggagcatataaagaatattgggcttaatcttttagagcaataggaagtcattgaaatacattattgaggtggatgacatattcaaatttgcgttttgaaaacattgcaatatggagaagagatgtaaggccattagtggctattggttgattaaactgatcttactgcagtactctaggtaacaagtaatggtagcttgggctagagtggtggagccagagataatgggtagataccttaggtatttaggagataaatttgacagaactggatggtagatgggtattagatgtgaggtagagaagat

SEQ ID NO: 393460 - DNA, 206 bp, Homo sapiens
gtgcttgactccttcctctcccagcatgtgcaataaatgaagaaaaaagccccaacatttaaaatggaaagtttatagaaatattaggtgttgggccatgtgcggtggctcatgcctataatcccagcactttgggaggccgaggtgggcagatcacctgaggctgggagtttgagaccagcctgatcaacatggagaaaccccgt

SEQ ID NO: 393461 - DNA, 291 bp, Homo sapiens
  misc_feature (153)..(153): n is a, c, g, or t
aggaaacatcaagaaagacgtggatattagaccagctgctctcaaacttgaggaggcaccggaatcatctggaggacttttagaaacaggttgtgctcacacctgtaatcccagcactttgggaggccaaggcggggtggatcacaaggtcanggagatcgagaccatcttggctaaaacggtgaaaccccgtgtctactaaaaacacaaaaaattagccaggcatagtggcgagcgcttagtcccagctactcgggaggctgaggcaggagaatggcgtgaacccaggag

SEQ ID NO: 393462 - DNA, 458 bp, Homo sapiens
gaaacatttctagtttaccatcagagttttagccgcttccatgcttctgtgactgcagctactctcaggaagctgcactgttgcagaggtccattaactctttcaggacggtgtggaatcagtggggaaatctctaattgctactgacacagagcttttaggggcctggcctttgcagttccagatctactacagcaaacatcgttcaagatgtcccaccaagaaggcagcacagacggcttaccagacttagggactgaaagcctgttcagcagcccagaggagcagtctggagccgtggcggcgacagaggcctcctcagacattgacatagcgacctcagagctgagtgtgacagtgaccggagatggcagtgatagcagggatggtggattccccaacgatgccagcacagaaaatcgaagctcagaccaagaaagcgcaagtgaagacatcga

SEQ ID NO: 393463 - DNA, 261 bp, Homo sapiens
atttgagagtggttatgtatgaggtggaggtggggaatccaggaaaaccatggagttatgaaaaaattaaaactcattggtatattttatttgaactaaagttgatacaatctccaagaactagaagtatttattacataaaatcatctttttcaaaagtatatgtaaaccttaattgctgtcagaaaaatatgcacaatagtgtgtatacttgcattaaaaagggatatatatatatatacacgcacacacacacacaca

SEQ ID NO: 393464 - DNA, 373 bp, Homo sapiens
aaattcgaaaccagcctgaccaacatggagaaaccctgtctctactaaaaacacaaaattagccaggtgtggtggtgcatgcctgtaatcccagctactcgggaggctgaggagaaaaaagttgataaagtacctgggagtagcttgatttcctataggaaatagataaatcctgtagtaatcatgattagaggggaatttattgtagcattgtagcacagtgagccattaggtgccctgataaacttctaattatagttcttcacaaatcttgaggttgtcctccaatacccacctgagaatgttttctgccactcaaatgagttggaaatatagtctatttctgctttacatttccttattgtttatctgg

SEQ ID NO: 393465 - DNA, 964 bp, Homo sapiens
ctccatctcaaaatatatatatattagccttgaggagaaaaatcaaccaatcaaaaacaactcgtagttaacacgaatgttagaattaacagacaagtatattaaaagttattataactgtattttacatatgagaaaagttaagtagaaacatggaccttataaaaacgcccggctgattttgtatttttgatagagatggggtttcactatgttggtcaggctggtctcgaaatcctgatctcgtgatccacccacctcagcctcccaaaatgttgggattacaggcgtgaggcactgcgcccggcagaaagaagaatttctataaacaaagagtgccattgagccatgcgacgatctaggatgtgttcgcatggagtgagtgaaaaaccgcaggtagctgcacttactcaggacataaaccctccctggggaaaagcaacacatctgagcctccagcagcccctcctggcctcaggcagaagggaggcttcagccacagctgcctggactctgagtttaactcacggaggttggttgctccaggttccctagtagagtagagctaaaatccaagtccccagactgctgctcctattcccacatactcacttctccccaggaagacggatgtgttgcggtagcgtcaggcacacgtccctgtgtggccttgggcaagttacttaacttttttgaattaaatttctttatttctaataggagtgataacgcttgtggaaggtggttattggagtatatgggggggataatcattgaaaaatggcaaaaactgtgagaggccgcggtggggttatactgtaccggtataaggaagggaacggagagcttgagccggtaaaaacgctggaatgaactttaaaattaaatcgtggttcggcctagggggggggggaccaaaaaaaaggggaaggggacacttaggagataaaaggaaagaagtaaa

SEQ ID NO: 393466 - DNA, 512 bp, Homo sapiens
tgcataaatattagctagatgactaaataagtgaagatgaaaaggtaggactggttatattcagtttaagaacactgagtttctatgcctgtaatcacagctacttgggaggctgaggcacgagactcgcttgaactcaggaggcataggctgcagtgagccgagattgcacctgcactccagcctgggcgacagagcaagattccgtctcaaaaacaaaacaaaccagtaacttaatcttgaactaacacaagccaaggtattagtaattctcttctttttggtggcacttgactttcaaagctctcaaaacaaatcttcagctaacagcattttccctgtagcattatcaattggatgtctaataaaaaataactcatagcctccttttctatacccaattaatataaacagattacttaccaattacctaaatttctaaatgatatccagaacaatattttaaaattttacaaaagctcaggggtaaatgcagtgcttatgacattcat

SEQ ID NO: 393467 - DNA, 509 bp, Homo sapiens
gctcaacactaattagctctttctcaatcctactcacctattcagtatcctttaagaatttctcaagatatctgtcatttattatttttgaacattgcagtgacatttagggaattaaggaaggtaaataatatgttttgtttttgaaattgtctcctagaagttatttcaaacatactgacctggaaccaatatgttttctgttttttaattccttgtttaatattttttaatttaaggggtacaatatgatattttagtatatgtataccttgtgaaattattaaatcagacaaattaacatatccatcatgtcacatacttaccatttttttattcgatatgttcttaaagatcaaactgctcctgactttagcaaaaattttaacaaatttatatgtgtatgaaatatatgtatatatatttatataggtatatattatataactaccatatttgatacttaatatgtacacataaagaacaagattaaaattgcttcaaaaata

SEQ ID NO: 393468 - DNA, 363 bp, Homo sapiens
aaactttgtaaaatatttagatacagttcagctgataacatctctttttgtattcacattccatgtttcttattaatacaggcttttacttaaaagcaggttcatagtttcttgaaggtgaactgtagcttaattcaagattggactaagctcaaaggtattcactggtatgtgccaaatccacccactaaaagattattcggaggcatttttcacataaatatttttccgttaaccttttaaaaagttttatttagcccctgtgaaatatgctggcacttgtaggttcattagagatgaccaaagacaaatacttgtggaatgagatagcattcttattgacctctttaggatcttagttga

SEQ ID NO: 393469 - DNA, 312 bp, Homo sapiens
ggaggctatgaaggagactaattcctagtacaatacttagctcagagtcagggggaatgaagcaagtagaaagatatcacaatgaattctgtgttttcagtattgctaagaggattctgaacaatttgctaagaaaataaagtgatacctaaattagagcacatgtgtgtatgtgtgtagggagagccttcaaatcatggtttcttgaggaagcaaaagcttaggtgagacctgaaagatgaattagagggagtggtacagacagaaggcagaaaaggaaagaaaggcattcatgtagagagagctgaatct

SEQ ID NO: 393470 - DNA, 192 bp, Homo sapiens
ctaggctgagatcttttggtcccagtggacagcttaaactgcctagaaaagagtggcattctctcttaatctgtagtgaaagcaataatgactggcctttaaaccaccttattgtgcctgtgcttttctgctggaatctcttttactttgggtttcacattttacccccatcagtgactgagaccagaggaa

SEQ ID NO: 393471 - DNA, 139 bp, Homo sapiens
tcaccgcgcccagctggggagctttattattaaacataagcacaaggaaggctgtatgcagcttggtgaaggagaggtagacacacaaggagaggattttttttctttttgagacagtcttgctctgtcgcccaggctt

SEQ ID NO: 393472 - DNA, 395 bp, Homo sapiens
ccgatgcttctttcctgcaggttccgccgagcccgtcccttggcggtggtgtcactggatgctgggaagagatggtgggaagagcctccatccattggcgcgtcactaattagacaaggaggccttgggctcccttgagagagtcacggtttctcctccgttgacccgcccttcattgaactcctttacttggatattcagagcgctggacagagatcacttggcgctaacaccctcggaggtcctcacggcgctccgtcggaatgacacagttggattcccaagctgcgaagggtgagggagggactgcagcgcaggaactgaggaggagaggcccgcgcgcccactggagccgagcggtgaggaataaccggaccgacccccgacggtgcgtg

SEQ ID NO: 393473 - DNA, 364 bp, Homo sapiens
atctttcatttttctattctataagcaatcgctggatcagattcattatccagactgccattaaacaaacaattgttgaaacttattagatgccaagcattataccaagcagcagttgatgtacattaactctttttttaagaaaaatattttagaccatgcccggttaatgtttttattttctgtagagatgggtctcactgtgttgccaggctggcaaactgattctaagtgaaaattcttcaagggatattagtttattttttttaaagaacttcccttatgtgaagttgtgaggttaacattttctttttttctagaagcagaaccttttaaagcctttacaagattatattgcagattt

SEQ ID NO: 393474 - DNA, 542 bp, Homo sapiens
agaaaggaggatatccacaaggtgatcagaacaaaagtgtaaattcggtgaatttttcttctaactctcgattacaggtccaaattaaacacgcattgcatcacatgtattgacgcccattaaaattgaagaatacttttagggtaattttgtcacagttattttctcctggctttctccctgtaaagcatgctgtgtgattctttgcgtgttgctcaagctctggaacttggctgcagctaaccagagacaccccagacagtgccagaagtttgtggctgacaatcaccccttcccccatggtgccccctcagtatggcacactaatcctcaaaaccttgatgggaaatgacaaaatcgctatggtcctcaggcatgcaaagacactttcctcgtgggcaatgaggaaacagttaaccacgcttttccaccgagagtggtggttctgctcattcacaggagtgggcgtctgctctgcccgctaagcagagctgctgctttggagggtttgtagcgctaggaggctttgagggcttgagaaa

SEQ ID NO: 393475 - DNA, 167 bp, Homo sapiens
aagttcatttctgccaagtagagggctgggggtctgtgtccctattgcatcttcaccagggggcctagagaaccaatggggccacgtgggagaagggaagaagaaaaccgttcttaactcgttagataagagacagtgtattcctaatgtgatcaaagccgatgggg

SEQ ID NO: 393476 - DNA, 234 bp, Homo sapiens
cagaacttaaagtccgatgaggaaaacaggcattaaatagatgtcgctcatagatataaaatgacaataatgtggtaagtgcttggaaggaagcatgcaagagaaatgagagtgtccagtagggtggggaggccttgcttggtctgggtctctagctttcctgaagaagtggtgtgtgagctgagagctgcagagggagctaggattcacagagtgaagagcggggatgaaacg

SEQ ID NO: 393477 - DNA, 303 bp, Homo sapiens
tccaacgcccagcaaactacagccgtgaggtcactttcttagagcaagcaaattgttttctgtaaggaaactattttatataagcacgagagcattatctgaaaaaaggaaaatgattcttctctagtacacagctgaaaactccctactgaggcatgacgtcacactgaacccatttaagggaggtcacgctcctccttccccagcacaggcaatcctgtacccctgagagctgctgtcgcctcagctgcttaaaatgcggagaagctcaaaagttaagctgtgacctgttctagtatctca

SEQ ID NO: 393478 - DNA, 292 bp, Homo sapiens
tgaatcgaatacatcgtagaacacatgtgaacaagagaaaacattaacaggagattataactgaagccacaactgcagcctaaaacagacttggctaataacagacttagctcataacagactctcaataagtgaatgaatgaataaatgagaaaaaatgaacaaacaggttaatttgcatattggcatactttgcattagtaatttccaaatatttgcattcaaatatttttgattgatgaatggttgatacagatgaatttctgaggtgctggtctctttgttttttttt

SEQ ID NO: 393479 - DNA, 337 bp, Homo sapiens
ggcaggaggatcacttgaatccaggagtttgagaccagcctgggaaacgtaaggagacctcatgtctacaaataatttaaaaattatccaagtgtgggggtacacgcctgtggtcccagctactcaggaggctgaggaaggaggatcagctgagcctgggaggtcaaggctgcaatgagccatgatcgcgccactggacttcagcctggggacaaaacaagaccaggcctcaaaaggaaaagaaagtggttcatcatgtaaaaggggtcctcgataagattaacagctgattgggaggccagggtgggcagatcacaatgtcaggagctcgagaccg

SEQ ID NO: 393480 - DNA, 354 bp, Homo sapiens
ggcaacagtgaaaccccgtttctttttaaaaatatgaaataaaccgctagttaataaagaggaggagaagcttgcttctgctttcctatgaagaccagctacaccaggtacagcctgacttcagcagcgctaactgtagcagggaccttttaatgaatgctaggcactgtttgaaacaatacgtggtcactcatttcaccctgaggtgacacaggcgctaccactgcttaaacctgacaagaataaacagtcaccaaccgggccctgatgtctcccagtaaggacgaatacagagaagcctgattcacaccccagcaggatggctcacagcctgtgctcttcagcccttcgctg

SEQ ID NO: 393481 - DNA, 575 bp, Homo sapiens
ccgtggtcccagctacttgaaaggctgaggtgggaagatcacttgagcctgggaggtcaaggctgcaatgaaccatgatcgtgccactgcactcagcctgggtgacagagcaagaccctgtctcaaaaagaagttatctgagtacctcctgtgcaaaatgagaagttcacgaggtgcagtggtggaccagaaatgaaactggggaaaatggcttcacgtgggagagagaagtcttgaggagtgatcatatagagacagaatctgtgatcctaaggtctggaagacgacagtttagatgaagaggtccaaaataacaaggggcttttgaacaggtggtctgtccagtagtgggagaagctaccccatcagggggtcctcagctcctaggtcttgagctgccaccgattcacagaagcgaaggctgccttcagaaaacgggtctggacaaccaggaacagcagtttgccaatgcctgtggctagaggagagggccaacctggatcgttcaggtgcacttctcctctcccctcctcagcccacccacgtgtgttctcagttgtctgggtaagtcagca

SEQ ID NO: 393482 - DNA, 555 bp, Homo sapiens
aactattggcctcaaccacttctcccacctgaccctcccaagtgctgggattttgggtgtgagccactgaaccaggtgcacagatgaattttaatggtgccctggaaacccccagcctcaaaagtaaaaatcagaccagcttgtgtgacaaactgtcacagtgcccaggagtcaacacactggatattttaatggttggtttgcattctactaaatgcatatgatgctattccctaggaaaagtctctgggtgtcaggtgtcagcagcacatgaaagatcctaagctggattttttctcttcggtgacgtcaattttttgctcaggtctgagacagaattgtgtacttggtcccaaaatggggtttgtttggatgcatgctttaaaaaaatttttttcaacaaattgcaaaaatgcagaaagtcttatgcagaaatatgaattcccagttgctgttgaataaacaggagttcatcaatggtgctaaggaaatttgctatgctcttcgagctgaggaccatcgttgagctgaggaacatcgttgagctgaggacca

SEQ ID NO: 393483 - DNA, 398 bp, Homo sapiens
cgagtagctgggattataggcgcatgccaccacggccagctaatttttgtatttttagtagatatggggtttcactatgttgaccaagccagtcttgaactcctgacctcagatgatccgcctgcctcggcctcccaaagtgctaggattacaggcttgagccaccatgcctggcctaaagcctaagttctttctactaactctgggtaacccagcctcccgtttttcctcacttcaaaccagccttcacatctctgcctgagtcagctttcttaaacaaatatgatcacatcactcccttctaaaaaactttgtatgcctcttcaatgccttcagaattaactcctaagctcaataaacaagaccctcccagcctgaccccagccttccctgccagg

SEQ ID NO: 393484 - DNA, 256 bp, Homo sapiens
ttttagtagagacagggtttcaccatgttagccaggctggtctcaaactcctgacctcaggtgatccacccacctcggcctcccaaagtgctgggattataggtgcaagctatcatgcccggccagatatatggtcatctttttaaaaaaaatcaggattaagtgtcctcatataagccttaacatattatgtagtaactgattccctgaatgatcagttccaaagattttgctactgtgccccaggaagcaaaca

SEQ ID NO: 393485 - DNA, 508 bp, Homo sapiens
tataaaaaatattttcagttgtttgtttttaccatttttaatgtggctactagaaaactttaaatcacaaatgtgggtgacatttttggcttacattccccttctattgatagtgctacatacagtcagaaagctaaactgatacatcattatttatcagcagccatttttagaggataaagggaaactggaaatcattttagtctaattcctcatttaataccttaattaaaatctaattcccccaaaattagctttacctaggatgccattgacaattaatagaagaatcattttaatgaaactcaaagcaatctctttggtggaaaatatctgtcttctggttatttgtcacctctcaggctactgcatctgtattctgattatatatctgtaagactagaaggcaataaactatatttctcagattccattgccaaatgatttcttattatctaatatcaatgggaaggactttggggtgaagagagtttgaggaaaaggaaaa

SEQ ID NO: 393486 - DNA, 597 bp, Homo sapiens
caaatgacagaaaaaactgtcaggtcaaacagacaaccaataagcagaaataaagagaagctgaacaatacaataagcttgagctattaatttcagcatacagatcttcacactcaacatttacaaaagtaagagtattaaggccataaaaaacacaaattaaaaaataaaaatcaaatgaattaagcattcaatttaaaaaactggaaagaataacatagagcaatcctaaaaaagagataacagcagcagtaacaaaagacagtatggaaaaggaaaaccaaaagcaaaattaatattctaaaaacttaataagatcaagacaaccagcagaattaagatgcaaaatacagaatatgaaaaccagatttttaaaactattgtaaactatgtactaatcaattttaaacctaaatatgtacatgtttaaaatatgaaactccaaaactgatgagagaacttgaataaattagtatgtttaaaaaaaaaaaaattctccaaaactcccctggacctctacttccccaactccaaagtcccaaagtaaatttttagaagagttctaccctaagaactgctaattgctatcttatgcaa

SEQ ID NO: 393487 - DNA, 384 bp, Homo sapiens
gttccataacttgcccaagaggatccagcaaggatttgtacctatggtctcactctttacttggctctcctgcctcccagatttttttccccagggatgcttctgggatgacctttaagaggtagacaggaccagtccctgccatggagaacgtttaggcataaatggtgaggggggtcaggtggtaagaggctgaaggtgtgacagcctgaggtacacctgtgatgagacgtggccctacttctttcagtccctcccccagggcctggggtacagagagggacagcttggcatctgccagtggggagatggacactggttcagtcaactttcactctcaccagctttgggtcaggcactaagctgggtaccaggaatcctgag

SEQ ID NO: 393488 - DNA, 344 bp, Homo sapiens
tcctcccatgtcttttccacattaattactttgtttatctagttgtaatcaaggggcatatacattttggtgccaattcgcatcttgcatttttgcagtgaatttttgaacctgaatggaagaatttatgtccctccttgaggtattgcctaatactggtttggaactcgggccttctccactttgtgtaattcacacacttgcaaagccaactttttgtacttcttagtcattactgtcagcgttaagactgagatgagggcggagccctatgttggcccattagagaatatcttcagcttagctgttccctgagccagggatccttttaactctactatcct

SEQ ID NO: 393489 - DNA, 294 bp, Homo sapiens
ttgccctccaatggggaaaatgaataatatttaagaagcaccaagttgaaggcgagtagcagcttgttggtatagtgagtgtgatgggaaagacgttctctttttcattcaaaacacaatctaacaattccatttagggtcttatggttacttgtgcaggatctaagagtgtctgtgttttagcttgggtgttcagggcaaacctctgtaggagagaacatttgagcagacacttgaaggaaggaaggaagccacatgtgaacctagaggaagaatgtaggagcagagtaagca

SEQ ID NO: 393490 - DNA, 265 bp, Homo sapiens
ctatgcgacagagcagtgcatagggagaatggctctgcttgccaagaagggactggcagtttatttgggtttgaaatccagtctgaccttttgccctgtgtatttactctgctgtctttattgttattgttattttccctccctaaatgtctactgccagaggacatttgttcctatgattagtgggtagacataatcccctgttggataaatcaatcagcctctgcttccttggcgtggttccgacagaaatattctgcgtatg

SEQ ID NO: 393491 - DNA, 369 bp, Homo sapiens
tgagatggagtttcgctgtgttgcccaggctggagtgcactggtgtgatctccactcactgcatgctccgcctcccgggttcacgccattctcctgtctcagcctctcaagcagctgggaccacaggtgtccgccaccacgcctggctaattttttgtatttttagtggagacgggggtttcactgtgttagccaggatggtctcaatctcctgacctcgtgatccgcctgcctcggcctcaaagtgctgggattacaggcagtcatcatcttttatctcttaaatgttcaatacccgctgaaaaacagaattactttttgggaaaaaacatctagatacgtctagatatttatcatcaaagcatttcc

SEQ ID NO: 393492 - DNA, 3537 bp, Homo sapiens
ggctgaggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393493 - DNA, 3833 bp, Homo sapiens
agttactggctatgtcgaccacgcgccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtgattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393494 - DNA, 3569 bp, Homo sapiens
ggctgaggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393495 - DNA, 1646 bp, Homo sapiens
agtacgagatccgtgttgatgcgtgcacgaccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393496 - DNA, 4164 bp, Homo sapiens
ggctgaggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaaaaaaaaaaaaaaaaaaaaataaaaaaacacaaaaaaaacaacagaaacaaaacaacaaaagatccacacgaacagaaaagccaaaaagggggggcgcgagcccacaaaagatacccccggggggggcccccaaagtcaccacgccacccatgttggtcggacaaaagaggggcccacaatgggagcacgctctaaaacagcagcgcgcgagccggcagcagataacaccaacgcgggcagcgcacagaggtg

SEQ ID NO: 393497 - DNA, 210 bp, Homo sapiens
ggtgggcctggagtgcgccacttctgcccccatcctgctctctcccagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaac

SEQ ID NO: 393498 - DNA, 3912 bp, Homo sapiens
ggctgaggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393499 - DNA, 3655 bp, Homo sapiens
agcggaatataaaattagccgggcgtggtggtgggcgcctgtggtcccagctacttgggagaatgaggcaggagaatggcgtggacccgggagttggagcttgcagtgagcagagatcgctccactgcacttcagcctgggcgacagtgcaagactccatctcaaaaacaaaaacaaaaacaaaaaacaatgcttatggggagtcttggggtctcctggcagatgggatggcgaaaacttccaccttgagtaacaagattatttcctgttccctcttgacaggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393500 - DNA, 3519 bp, Homo sapiens
tggtgactctagaggttccccaacgtcaataagcgcaggtaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccacgttcgggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393501 - DNA, 2073 bp, Homo sapiens
agttactggctatgtcgaccacgcgccccgcgtccctggggggcggcggcggcggcggcagcgcaggcggcagaggcgcaggcggcggaggcggctggggggtccggaagtcaacaccatgtcaagtctgcacaagagccgcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccagaaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcaagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaa

SEQ ID NO: 393502 - DNA, 397 bp, Homo sapiens
aataaagacggctctatcatctggcctggggtacagtggcataataatagcttactgcagcctccaactcctgtgctcaagggatcctcccacctcagcttcccaagtaatagggaccataggcatgtgccactgcacctggctcctactctagattctttccctgtgtaatttattatactacttaagacttttaagctccagacagtatatctgaaacctggttcaatatctttacaaagtttaatcctcctccaatctttcccatttcagtaccaccaattgctcaagtcagagctactactagtcaaactactacaggttactatgatagtacacattcctgccacctctctggaagccactcctgagtcttatctgcagatctgatttggcc

SEQ ID NO: 393503 - DNA, 343 bp, Homo sapiens
gattacaaatggacacatataaatgaatcttacaaaaatgtttttttgtaagtccattgtttcatcccttttgagaaggaagggaagtattagctttctgggatggaaagatattggggtgatctttggcatgactacagaggggttgaggattggaacagaaccaacttccatgtctatttatttactcgattattaattttatttatttatttttctttttttcttttttcttttttttttgagaaggagtctcactctgtagcccaggaggcggaggttgcagtgagccaaaatcgtgccaccgcactctagcctgggcaacagagccagaccatatctc

SEQ ID NO: 393504 - DNA, 516 bp, Homo sapiens
tttttgagacggagtctccctctgtcgcccaggctggagtgcagtggtgccatctcagcttactgaaagctccgcctcccgggttcacgccattctcctgcctcagcctcccgatgctgggattacaggcatgagccaccgcgcctggcctttgttaaatctttatcttggatcttacttttccagaaaaaaccttggataattagggagttatttgtcttttggtcatttttaaggcattaaaatgacctctttttcacttgagaggaattctgtttgtttactccacaaatacgtactgagtgcccactgtgtaatgagcatagttaaatacacaagatttggtcagcaagaacttgttcccctttccatcttctgtaaaaagtatggtatgtaggcttgtggtggatgcacgtgaaggaccacctacttagtcctatcagctgacgcactccgttatcagaggagtagcagatgctatagccgtgttgttctcatgtggaaagaggtggcaga

SEQ ID NO: 393505 - DNA, 799 bp, Homo sapiens
tctaacaaacaatcctaactcattctcaagttttattctgcttaatggaaaatggtagaagaaaaagcctttgcataactacccagtgaatgggagatttcattcttttccataagttgagggctatttcctgttttctttttcatttttttttgagaaaactaacccttcattgagatatttttaagtcgaatatctagtataaaaagtttgcattgtttcagcttgttttcatttaaacctgtggttgtctttcatctgcttctggcaatttttttttttttttttttgagacagggtctcgctctgttgcccaggctggagtgcagtggcacaatctcggctcactgcagcttccacgtccccagttcaggcgattctcctgcctcagcctcccgggtggctgggattacaggtgcacaccaccacgcccagctaatttttgtatttttagtagagatggggttttaccatgttggccaggctggtcttgaactcctgacctcaagtaatccaccagcctcgacctcccaaagtgctaggattacaggcatgagccaccacactccgcctacttctccattgaagtgctctagttttggtaaaatcttctccttgacttcaggaccctctccacatttatccccagtctataactcgcatatttcgtgttttcaaacagaaaaccgtaattcaggagtgaacagcatcctctgtaaggtgtcacaggagcagcctgaaatccattaggcagtcattctgaagctgtggtgaaatcgaagggaagctaatgttgcag

SEQ ID NO: 393506 - DNA, 349 bp, Homo sapiens
aaaaggatactttcagagggggtaaggctctgctagttgttctccttgcttctaatataaaacaaaacaataagaacctttatcacaaaccttaataataaccctactcctactgtaaatggagagaaatgagatgatgttagctccaaggatttccaagtctcctaagaagtttcctaaaaccacaccctcctgggaaccctataggattgggattagattcattgggtttcaacatgagcctcatcaataattttcagataaaataaaagtctttggttatcttatttctttatctttagataaaaagaagtctttaattacacttgagagtatagagaacacttga

SEQ ID NO: 393507 - DNA, 357 bp, Homo sapiens
ccccttgcttgctcaggtctcatggacatattactgacagataatttctttaagcttcaggttctacctctataaaataggggatgataattatattttatctgtcagtgcacattgtgactgtcaaggctgaattttgtgaaataaggtcaaatgaaacagtgtatgtgtaagtaacttgtaaacagttaagcgttctatacaaattttttaattactataagaatcagtttcctctggtaacctttcatcttgagcagggctcaacatagactttttatactgcaagctgtggttttgtgggtcatgttttaggaaggcagcaatgtatttcggagcagacctaagcaagcccgg

SEQ ID NO: 393508 - DNA, 571 bp, Homo sapiens
gagtacacattttcagttacaagatgaacaagttttgggaatctaataaataacatggtgacatggttaaaaatactgtatttaatatatacttgaaacttgctaccacagtagatcttaaatattctcaacacgcacacacacacacatagacggtcatggtgtgaggtgacagatatttcaattagcttggttgtggtaattatttcacaatgtatatgtatatcaaagcatcatgttgtacactgtaactatatacaatttttatttgtcaaatatgcttcgataaagctgagagggggggatagaaaacaaagaaatttctcacaatgtctctcagtagatctaagggtaacatattaaaaactcgaaaatatttggcccaatcctgggctgctaacatgggttagtggaaaagtgcactgtggcgccagaaaggtctgggttcaaatctctatcttgctgtttgctaatatttcttaacctctctgaacctccaatttctcctgtgcaaaatgaatataataatacccatcttattggactgttgcaagatttaaacaaaaaaaaa

SEQ ID NO: 393509 - DNA, 465 bp, Homo sapiens
cctctcaagtccagaatgtggcatgtgatggaaatacatcgagttcccaaatccagaaaccctcagccttggggatctcctggaaactcaagaaatgagaaaaacctggtggagtggacaggtatagggatagacacggtggccccaagagcaatggctgttgagacagccagcaaccaacctcggggccactccctgattctgtctggcccctgtaagacctgggccctcccacggtgggagagcctatactcccaataaggcaggtgggatctgccatgggcccagacttcaagggtcacggctcttggtaactagagcggcttctctatcaatctctctctctctgatacatataccaatcatataggcagacagtacaacaaataaaactaaacactgcccagcctgcagcaagcactcaagaaaaggtagctgttaaccaccatcccctgtgcctggccc

SEQ ID NO: 393510 - DNA, 342 bp, Homo sapiens
gggaaacttggaaagtaaaagcacaaaaaatatttttttaatcacctgtaattcatctccccccaaaattaccaccactaaaatatggatttctgtcttgctagtatatgtttctgtaaataattatatattaagcaaaaataagaacatcttgtgatactgttatgtaactgcttttttccacttagatcatgtccccatgttaataaagactcacataaaacatggttttagataaggtatctatcatgaaatttagtggggttttttttgtttttgtgtttttacagggtgatggtatgtcccctaggggccatgtagaaaatctgggggctatttgtg

SEQ ID NO: 393511 - DNA, 641 bp, Homo sapiens
aagggccaaggcagtctgagacatgagcgagaaaagaaaactgccttcccaaaaagtgtacttgtgcacctgtgtcagtgcatctgtgcatatgtgtaggtgtgcatgtatgtgtgcatgtgcatgtgtgtgtgtgtgtggttggttggttagggctgtaaagggggcctgttgaagaaaacaaggaagtcctagagggaaatggagaagcgaaccttcccaaaccaagggaatgttctaaattggcccagctgcttggggttctggaaaataggtaccacacctaaacttcccaagctttaaagtgtgtttgaaccacctgcggatcttgttaaatgaaaatcctgattcatttgggttggcagaggcctgagattgtgcattcctaacaaatccagacgatgctgatactcctgctctgaggaccacattctgagtagcgaggagatggaacacacccaggagtaagggaccagagaaggccgattggtggctaactgagcagaaacagagacgggaaacaagaacggaaggtgataaggtcagacaaatggacccagaggtacctactggatatcaaagtgacctcgctggtaattaggatgcaagacctctggccagccctgggtagcactgattca

SEQ ID NO: 393512 - DNA, 358 bp, Homo sapiens
cacctcagcctcccaaagtgctaagattataggtgtgagccaccgtgcccagcccacgtacatatttttttttccaagcagttaaaagtaaatcgcatgcatcatcctcctttaccacataatacttgaatatcctaataagtacattctcttatgtaaacaaaatacatacaattaacaactccaggaaatttaacattgctgtaatactttaccatccatgttccaaatgttgtcagttgatcaaataacatcattcttagcattttttttattttccagcacaagatccagtttaggatcatatattacatttaattgtcatgtctctttagtgttctttaatctggcacagttc

SEQ ID NO: 393513 - DNA, 846 bp, Homo sapiens
cgtcgatcgagccggtcctcgcgacgtgtatcctagttctttcacataactagtaagtggaagaactaggataacagtgacttacatttattaagaggttctaagaacttaccatatttaaatctcataattgctgtgaagtaggtgggattattagtttccatattacagatgaggctgttttctagctgtcattctacttcctctgtctatgatgttcttctcccttttatctttccctgctttgaggcttttataaagatattctcctgagtcttcttaatagctttaaagttttaaagtatttcagaagtgggtctttggtatatctggaattaattttatatatagtataagataggaatctagttctatttttccccatatatggaaagacatttatttcaacacttaattttttgtcatttctattcttctgcaacttctgcagctatgagatttgtttcagattctctgttttctttgagttctgcttccctgaaccaatatggctgttttgttttgttttgttttgtttttgagactggggtttctttctctctgtcacctaggctcgagtgcaggggcatgatcacggctcactgctgcctcgacctctcaggctcaagtgatcttcccacctcagcctcccaagtagctgggaccgcaggtgcacaccatcatgcctggctaatttttaaatttttggtagagttggggtctatgttgcctaggctggtctcaaactcttgaactcaacatccttccatctcagcctcccaaagtgctgagattacagatgtgagccaccacaccatgattgcattcctggatatcactgtttaa

SEQ ID NO: 393514 - DNA, 867 bp, Homo sapiens
  misc_feature (816)..(816): n is a, c, g, or t
cgtcgatcgagccggtcctcgcgacgtgtatcctagttctttcacataactagtaagtggaagaactaggataacagtgacttacatttattaagaggttctaagaacttaccatatttaaatctcataattgctgtgaagtaggtgggattattagtttccatattacagatgaggctgttttctagctgtcattctacttcctctgtctatgatgttcttctcccttttatctttccctgctttgaggcttttataaagatattctcctgagtcttcttaatagctttaaagttttaaagtatttcagaagtgggtctttggtatatctggaattaattttatatatagtataagataggaatctagttctatttttccccatatatggaaagacatttatttcaacacttaattttttgtcatttctattcttctgcaacttctgcagctatgagatttgtttcagattctctgttttctttgagttctgcttccctgaaccaatatggctgttttgttttgttttgttttgtttttgagactggggtttctttctctctgtcacctaggctcgagtgcaggggcatgatcacggctcactgctgcctcgacctctcaggctcaagtgatcttcccacctcagcctcccaagtagctgggaccgcaggtgcacaccatcatgcctggctaatttttaaatttttggtagagttggggtctatgttgcctaggctggtctcaaactcttgaactcaacatccttccatctcagcctccctacactactatgattaccgacgtacgcaccaacanccatcaattccttccctcacactcgatgatcccgggaccgagctcgatcta

SEQ ID NO: 393515 - DNA, 852 bp, Homo sapiens
tgacatgatagaatcgagctggtaccgggtatacggggtcatcctagtacaattataagtgggatcgtggtagagtcagatgaggtgtgtaagatgtgtaaggaggtcgtgactagtagagtattgggtctcataattgctgtgaagtaggtgggattattagtttccatattacagatgaggctgttttctagctgtcattctacttcctctgtctatgatgttcttctcccttttatctttccctgctttgaggcttttataaagatattctcctgagtcttcttaatagctttaaagttttaaagtatttcagaagtgggtctttggtatatctggaattaattttatatatagtataagataggaatctagttctatttttccccatatatggaaagacatttatttcaacacttaattttttgtcatttctattcttctgcaacttctgcagctatgagatttgtttcagattctctgttttctttgagttctgcttccctgaaccaatatggctgttttgttttgttttgttttgtttttgagactggggtttctttctctctgtcacctaggctcgagtgcaggggcatgatcacggctcactgctgcctcgacctctcaggctcaagtgatcttcccacctcagcctcccaagtagctgggaccgcaggtgcacaccatcatgcctggctaatttttaaatttttggtagagttggggtctatgttgcctaggctggtctcaaactcttgaactcaacatccttccatctcagcctcccaaagtgctgagattacagatgtgagccaccacaccatgattgcattcctggatatcactgtttaa

SEQ ID NO: 393516 - DNA, 667 bp, Homo sapiens
atttggcaggctgtcatgtcactttatgagcttaaacattcagccttccaacatggcttactttctgcatgatcagagaaaggacacacataacccagtttaatacagtgtttgtcaaaacagaaggcaggatgccttggcctctgtctagtattatgtaaatattcaaaattctttttcttttttaaaaaaaaaactcccatgaacacaaagctctttaaccttgcctttcttctacctattctccagggagttgagtgggtcagaacattttgaaaatcatcgttttaaatatcaagttcatattttaaattctacatttttcatactttctgctgttacgatttaagtctcatttcccaaagcaggcttcttaacttgttagctataagcaaattgaactactggtgcttttttgcttttttaatgtttatttatttgttgggggttttgttgttgtgttactgtttatttcagttaaaagcttttcttaagttgtgtttggcattttcttctggggagaaggaaaatttcaaaaacaagaccaaagaaataacaaactcgcagttagcataaaataataacaagtagaaaattttggctgaaacctctatattcactaagttttccagaggcaaatgttatagctaatcacttccatatttgc

SEQ ID NO: 393517 - DNA, 781 bp, Homo sapiens
taatcagaaaacaactataattcacactatttagtacccagaatgaaaatgatttaaggtcatagatatttgttggtaatacaagattaagttgattattaaagatgctaaactttcccaggcacagtggctcatgcctgtaatcctattgctttgagaggctgaggcaggaggattgcttgatactgggagtttgagaccatcctaggcaatatggtgagaccttgtctctacaaaaaaataaaaataaacaaatttagctggatgtggtggcacacacctgtagtcatacctatttaggaggctgaggcaggaggatcgcttgagcccagaaagtggaggctgcaatgaactatgaccatgccactgcactccagcctgggtgacaagaatgaggtctcatctcagatagatagaaatttttaaatgctgacttattttctattactgtttatttactattcggacaaaatttagtcacctgtcattttttccctaaatttttatttactttaaacttaatgtaaattagattttaatctaatgatgtattttgacaaaacatggaatttcatgacatttttttactaacaaaagtcggaatcctaagatagtatgttctaactagttcagtgatggacatattgtctactattagaaggtaaatcatagtctatctcagtgtcctgttctttaataaaaactttagtttgcacatatctactctttatgttttttaaagtatgtctttctggacccttgaggtaagtgttacataaat

SEQ ID NO: 393518 - DNA, 413 bp, Homo sapiens
tcgctatcatcggcaccccccagccagtctctctgattccgtaatgtggttggtgattattataccttaaggtacttgtacttgcttgtgcctcttttccatcagtactagggtttcttattttccttatcctcccaagctactgatatagagagccctttaagaaattggagaagatacattttacctctctaaactttgtttctttcgctattcatcggcacctacctaacagattagagaataaacctgagaaatgagctcattattctacttaataaactaccataagcaagcaatgtactgggagttagggatgtaaacacaataatagtaactacatttattaggcaccgaccatgcacgaagcagtctaaacatgcaagtcttaatccctgcagccaccttgtaag

SEQ ID NO: 393519 - DNA, 447 bp, Homo sapiens
gtatctcagagcaacataggttaaaggtttagacagtgtcttggagggagggagcaagggagaagtagggaagctatattagctaggtgatgaggaagagcctggctaatagaaaaggtgatggggaatgcatccaggcagagggaagggaaaaggctttgatacgggtgtgatctggtgtgttcagggaagggcagaaaggccagcatggttgcggtacagtgatgaaaaaagggctggaaacgaaagcaagcggcaagattacgtaggccatagaaaacacttcatattttattctaaggataatggaatgtcatccttagaatggttttgagcaagggggtgcgttgatttggtttttcttttattttccttttcagagacagagtctcgctctatcgctcaggctggagtgcactggaggaatcacagctcactatctccttg

SEQ ID NO: 393520 - DNA, 450 bp, Homo sapiens
ctgagtagaggccatacagagagacaagcagagactcattaacatccaccacaaatctgctgtgttggagaaggaaagaacatggaacagggaaaaatgacatgggagctaattagtcccagagaggggcaatgccttacccagggtctggcaggacgggtgctaggcccccagacccaggtgaaatgttttttcttgttttgaggcactttcaactcactttatcataacagccctgagaggaataggaagaacaggaatttaaagcctatctaccttatagaagaggaaggtgacagcccaagattgagaaaggcctgaggtcacaccagatcaaccatggcatccattcccagcctcagcttcttggggtcaggataagcattccttgtggtgcaggaccctctcagatgcagcccaccatcttggacagagtcctgggcaaggacc

SEQ ID NO: 393521 - DNA, 470 bp, Homo sapiens
gtagcttccctcgccgcagctctcccagcctctccctctggatccacaggatcagcggccccagccctccgccccacgtggcttgctgcattccgggaagggggtggaaatgattcactgggggaactgtgactgtcccttcctcgggcggggatgcgcctgcgaggtcccagcggccttccctgggcggctgcgccctccctcgcgcccagggcgccccgaggcctgcgcggcggcggaaggggcaggtgcgcctgcccgcccgggtcagccctccacctgccgccgccgtgccccgcagctcccgcggctccccgccccccgcgctctttgttacagcccgacttcctgtttgcggcagccgacccggctcacttcccgggccgggaagccgccgaaggccgcgagcttctcggaggctcccccgcccgctcggctccgcctcctgcctccccaatctcgctccggcc

SEQ ID NO: 393522 - DNA, 351 bp, Homo sapiens
ctgcacttacggtaggtgtgggggagcacatgggctgtgtgagagcatctctgtagggcctgcatgccaggctgtccgtgggcacctctgtgtaaagggcgtgaagctctcctgctccatacttggcagcagctggggtcccccacaccccacagccccacggcagcagagcacagggtgctccacatacctatgtgacaaggactcgaggactccgctgcagatcctgcctcaaattctatcagataaggcaacgctggctgcatcttccagagagggaacctgggaccggaagaggcagaggggcacctcaagccccacagctgctgagtggcagctctgagaggaagt

SEQ ID NO: 393523 - DNA, 342 bp, Homo sapiens
tggatcccaagggcctgttggtgaacccacagtggaaatgtttacctggggtcattttctacaagggtaatgccagtaggatgggaaacctcatcagtatgaggctgtggggaataccatggggtatagaagctgaggggtaaggtgtggctggccacaggagaggcactgcccacattggcaaagtcatagttgtggaggcctactaaggaagtaagtctcaaataacctgtgaaaataatattcacaagagagagctggctctagcccatctccttggccagagaaaaggaatctttaagtatcaagcaagaactttccttcactatgccccacagtgat

SEQ ID NO: 393524 - DNA, 501 bp, Homo sapiens
cctatattttctagatttgcaagatcagatcactgcagttagcaataagtgttacagtaagctgtataaaaaacaattcagttaaattttctgtctcagaaaatgtctcaatttttaatcaagacagagaacttgaaaatttctcttctatcatacaccagaaaacgtacacaatgtttaccatgcatccacaattaagtgacaattagagatcagcttaagaaaatggaaatcataatgatgaaaggtaagagaatatgccatcccaaaatatgccactttgacataagaattattttgagctgagggcaattgagctacaaaaaagcctctcttccctcttcctatttgtctaaaagcaggacataaattggtaaaggtgttcttactcccctctctgcccaaataacagaagttaatcaccagagatgtacctagacccttatcagcccagagatggcactagaggaatctacaaaacagattactgaccagcccata

SEQ ID NO: 393525 - DNA, 203 bp, Homo sapiens
atccctggggtctggagcccctgctctggggaaggagaggtggggcgctgccttcccacagtcccctcaagctggcagggactgctgtacccccagggtgagaggagaactaaaaggagcggaagctggcctgggtccggggagagccctcgtgtttgcccaaaagggaactggagaagggtggctgggcccatacgcaggga

SEQ ID NO: 393526 - DNA, 488 bp, Homo sapiens
agcagccatgtgaaagaccccaggcaagactagcagaagagctgcccagctgagcccaatccaaattgcagaattgtgactgtagataaccaggcacaaattcacaaaatgatgaatggcagggccaggacttggacccaggcagctcaggagtccaggacacatgccttcaccactggcacgaagcccacaaagaaacagcgaagcccatcagcaatgacagaggacaaaaatgtaattatcatctcttcaagaggacgaaggaaaatatttgtcaaccaaaactgtctttcagctcaactgtctttcaagggcaagggcaaaataaagacatttcagacaaagactgaggaactttaccactcacagctctttgctgaaagagctagtaaaagatgacctaaggaagaagggaatcaagccctgtaccaagcacattctgcaagaagcaatgaatggagatatggaaacatgggtaaaatctaaat

SEQ ID NO: 393527 - DNA, 418 bp, Homo sapiens
tagcgtagatttgagagtatagattgtctttcagattacagaactagtccctgacttactccagaagttaagtagcagagcttttaccatgcttagttccaaattctagaacaacccccagccttctccaaagttaaaaacagtctaattgacagtggttgattttggctggctgggtgatgatgaaagaaaggagagcacttgcatagtttatggtgaagataaagcacatatcaggcattgtaattatctagccgcacactataaacttttccatttcattcatttccgtatctcttgctctttattgtcagttgcagaggcacaacacttttctcaggattcatgatcaactctgccctttggaattgttcctactgtctaaaaattaattccacatgcatgtacaaacttacat

SEQ ID NO: 393528 - DNA, 344 bp, Homo sapiens
tttttttcctaccttaaattattaataggaatgccagtctttaagaaaacacctctggtaagctttgctgggagaaaaacacattggtccgcaattctgaggttattatacactaaagggatttggtgacagctaatattcaagttttctgctaacagactgattaaatgctttacatttccgtagtgtaaaatacacactcttgtgtttattgcaaattgtaccgtttctcattttttgacttgtgcatgataagatgcattgcaggaaacctgttattttttttttctaacattcactcctttttcttccaagtttaagaatcaactattttaaaagttcac

SEQ ID NO: 393529 - DNA, 484 bp, Homo sapiens
actgatacatcctggtgcatggctgaataaatcactgaatgaaagactgcacacttccaattatttaactcagactttaagttccctgggagcagaaaccctggtcaatcttggtcacccagggccaaacagagtttctgtacacaggccctccttaagtactttttaaaataaatgaatgaaatgaaacttaacaaatcacgatcaggcgcagtagctcgtacctgtaatcccagcactttgggaggccaaggtgggtggatcacctgaggtcaggagtttgagaccagcctggccaacatggcgaaaccccgcctctactaaaaatacaaaaattagctgggcatggtggcgggcacctgtaatcccagttactcaggaggctgagcaggagaattgcttgaacccgggaggcggaggttgcagtgagccaagatcatgccactgcactccagcctgggcgacagagcaagactcagtctca

SEQ ID NO: 393530 - DNA, 771 bp, Homo sapiens
tctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacgg

SEQ ID NO: 393531 - DNA, 343 bp, Homo sapiens
tgtcataaatattaaaaataaacaaataaaaaagcatataaatttctagcaattgtccagaagatagaacagactactctcaaaacagtatgttccctttacaccagaaacttccaagcggaagctggctaaactatctcatctttcaggaaatattccagaatcatttccagtaaaaagtcagttagatggtctccaaattctttctagttcccgactataacaaatatcatcaacctaaaatgacaccatcacttacaacagaaaacaacctgattttaaaataggcaaggctgggcgccatggctcacgcctgtaatcccagcactttggaaggccaagg

SEQ ID NO: 393532 - DNA, 832 bp, Homo sapiens
ggtgtcagagattctgtctataggaacagcagggagtaggtggttcagcatgctatgtgactctcagcagctatagggaagtgggccagagtgcaccagtgcatgcatcctggtcaggtcctaactataattctgcctaaaatctggcttgtaaatcttattagtttctccaatggaagggttatcaaattaattgaacccaaggtgggaacttgaatgtatagcctgttgagaagtatgggtaacaacttactacttgtgatttgcatctgaagtggggagtaggagtagtcttgtgggactgagcccttgatctgtggattctgactcttaactcaaataagacagtgttagaattaaattgaattatagggtacccagttggtgtcctctagagtattgcttgatgtgtggagaaaactccttcacatttagttgtagaagtattctacattgagtgtgagagtagagagagaaaaagagtttttttacccatagtgtaggattttgcatggtcacccaaattaaataatggcaaaaaaaaaaaaaaaaaaaaaaaaaaaaacttgtgtggggggacttgggcccctgaaaaactttttaagacacattcgctttggggggcgggccccatgtggtctagtggaccattgggctaaacggggccccagagagacacgcggggccaagacacaaggggcgggagattcccacccgaataaaaaacagccgggggggcaacccaagcgttcctcgacacaacccgagagggagctcggagggccaacaaggggaccatctaaacgggagccacaagagccgaataaagtca

SEQ ID NO: 393533 - DNA, 428 bp, Homo sapiens
ccaccttatgcgtgggccatatgccgtggggacagagcctgcaggaatctgaattttcgaccttatgggggtggggcagcaagggcctcccaaacccaaaccgagaggttttcactgaattttttgtattttgggtgttgcccagtggctctttcctgaggctcagacacatttttgtcattcctgagtctgggcctctgctttgcggcctggacagacagacagacagggtggcttggacagccaggggaggggaagggtctccgcttccattctgagtcaatattgatgcagcaggacattagcctgacccgtgacctcccccaccagcttttcctttccccacaaataaaagccagacccccagaaggcctccagaggtcaccatatcactcaccaggcatttctaagcctcctctccttctccc

SEQ ID NO: 393534 - DNA, 581 bp, Homo sapiens
agtacttatggatgaagaagctctgcaaagtgacaataggaacaaaacatcggcagtttctggcttggatcatatttcctttttccttcagactgtgaagaaaagtgagggaaaaaaggtgagagacaaaggaattgggtatacctcgtttaaacctgctcagtttctctgctctgccttgaggagacactgtagtaagcatttgatagagacagtgatcccacttcacgtagttacctgaggcacatgccatagataggcagcatctcctttaaatcaactgcaacagggattacgaaatcagttggggcaggcattatttctcaagcagattgttttgtatcctctacagcaaaagggcaaaggtcttattctgtagaactggattctaagatgcaatttcttcattcctttagctctcgccatctgtcactgtttaactctttgtggctatgtggtttgtctccccacatagcttctaagttcttagagagaagacattgggtcttactgtatgtcccctgtgcctggaatagggcttgaggaggggtggtccagagctgagctagcacatatggtaa

SEQ ID NO: 393535 - DNA, 304 bp, Homo sapiens
ccctcctccggcatcttcctctcccatttttaggggagtctactagatcatattgctctgtagagtgatatgtgcgtgtgtgttcatttcatccctgaacttctgtggacagggaacagatagcattaacagaaacagcagcctagagacagagatgaccaggagaggtaacctcttggttgctcacataactctttgggagggttgcagcactataggacttgagctatattccctaagatttcaatggtatcccaggctgcaaaattgggcacaccgtggattagctgtttctgatgatgtc

SEQ ID NO: 393536 - DNA, 297 bp, Homo sapiens
gtccattatggctatctaggggccatctcattagagccactgatggcaacagatactgtactgagagaccctgcagctggcttagaagggtgactctcttaccttccaccaggttccattcaaaccagaaataactgtgaagggagcaggaactctgggcatcatttgctcaactacatatcaccagtttgaattggcttagacttagaatcatagaagtttttactcaagaggtcacacacatctaattttcagccctgttcctacaccctgcccattattgttcttgaaaaaagg

SEQ ID NO: 393537 - DNA, 443 bp, Homo sapiens
catttagtgtacttctaatacatttaagttagtataccttccagaatatttctcattaacatagaatcccttctgatttttctttccaaggttgggtttaagaatacacctggtaggctgggcacagtggctcacacctgtaatcccagcactttgggaggccgaggtgggcagatcacgaggtcaggagattgagaccagcctggccaatatggtgaaactctgtctctactaaaaatacaaaaattagctgggtgtggtggcatgcgcctgtagtcccaactacttgggaggctgaggcaggagaatcactggaacccgggaggcggaggttgcagtgagctgaggtcgcatcactgcactccagcctggtgacagagcgagactccatctaaaaaaaaaaaaaaaaaaggaatatacctggcaatttatcagagaatggg

SEQ ID NO: 393538 - DNA, 278 bp, Homo sapiens
ctcatgcacacagcaaaacttcagaaggtctggccaagagcacacaggaaataggagctgtgagctgaatgcttctcagagctcacatttttttcagttgtgtttccatggcatcaacctcagctcccttttccttatagttcacaaattcaacctagccaatctcaaccatgtctacagcttcacccacgttggtaacttctaaaaccacattgtaaacatcaccactagacctccagagtcaattctagccccctcccttatatgacaggccaata

SEQ ID NO: 393539 - DNA, 416 bp, Homo sapiens
aaacaggtataatcgttctgcaatgggaaaaaccccgtggagtttttacatataaaataaagcatatggatctataatgtttatgaataccctattaataatttattatttatgaatcctgtttttatatattttgccccatgacaggtacactcagtatgaaatgctgaattataaagctcctcactatgtcttgacatggtttttgcctttatgtgtaaagtcacatgagaaataaatatttttaaagttctgaagatgaaaggcataaggaagcatacattccacagttttgtcaggaaacacaagagactgcttttctagcttttccgagacttcattgcttccccatcagtgctctgttctggcctagccatgaaaaatcaagaagcaaggatgatacacctatttagaag

SEQ ID NO: 393540 - DNA, 288 bp, Homo sapiens
ccaactataaatgagagagaaaactgttttacaatttacagtattctaacaaaataatccagtgtgacagggaagaagtcatcttggacgaattacataacttctctaattttttggtgtcctgatccataaagcagagatagtgataactacctttcaaattttctacaaatactaagtgagatactatgtgtacgttacctggtatacggtaggtacttggtacaaatgccacttgactttcctacctaattatcctgtttatccctgactcccagccaagatgcc

SEQ ID NO: 393541 - DNA, 299 bp, Homo sapiens
caatagcccagcgataacatttgatcctatcatgttatttctgttttgcatgaagtgagtaagctgaagtctagagaaactgagatattgaaatcttattcaaagaaaatgcaaacctagcatcctaatttctttaggcccatgttggtaaaggtgactgagatggagacagttcataaagagcttaggcatgtagatcacaaaaattgtccctgcatgtattcagcttaagttttagcccttcaattggatttgtgattccagagttatttctaaatatagaaaaatgaaccatagca

SEQ ID NO: 393542 - DNA, 526 bp, Homo sapiens
gctgaggcagcgctaggctcaccgatggtccatagtcattgtattgagctaatagttacacacccttcgttacatgctgggcaatgttctaagcgatttacacatattcaataacataatcccttaaataacccatgcagtaagtaccatcattggcctcatttttcagatgggggaaagctgaggcatacagaggtgattccatgctgcaaggtcacccagcccatacatgatgggtgcagacctggcacccgggcagtctgcttccagagaacaggctccgtgctgctgcactgaacgctgccccagtggggctcaggaggaagggctttgacctcaggcagcacggggtgtgaaccccaacaccactgccatgtgtaagtcacctcccccaggctcagtatcctctcccacaaatggggctaatgatacttaccccagagggtggctgtgaagattaagcaaaagacatctcaagcatctggcacagttcctggcacttacggggcactaaacaagaggctgt

SEQ ID NO: 393543 - DNA, 412 bp, Homo sapiens
tttgactttttccttctatctctttaaaaagtagttaatgatctataactatactattcctattcaagtgtggcattgacaatttctactatttaagagatagtatagtgtaccatataagggacagtaaaaggaattgcaattagcatctaatttgttctgtctctggaattttgcattttaaggcacacctgatgttcctttcaagacatctaaaaatgttatttttttgtcaaaatagttataatgtgacagcatgtggaagtgaacactttaaaatatgaaatgaaaatatagtattttcaactatctaaaaagtggcccttccatcacctttcctaagtggtaaagctgggattcatatccaaggctgatggaaagaccaatcttgagctacctcctcactctgcct

SEQ ID NO: 393544 - DNA, 450 bp, Homo sapiens
caagtctgctgggcggggacagagcctgcagtgtggaatgcctgccaatcagccattcatccaaggggcgtttgttgacctttgtccttgttaaaggacagcgcacctgctgtgtactagaacgtctgagcgtgagagttgagaatccctgctgtgtactagaacgtctgagcgtgagagttgagagtccctgctgtgtactagaacgactgagcgtgagagttgagagtccctgctgtgtactagaacgactgagcgtgagagttgagaatccctgctgtgtactagaacgactgagcgtgagagttgagagtccctgctgtgtactagaacgactgagcgtgagagttgagagtccctgctgtgtactagaacgtctgagcgcgagagttgagagtccctgctgtgtactagaacgactgagcctgagagttgagagtccctgctgtg

SEQ ID NO: 393545 - DNA, 221 bp, Homo sapiens
aaaaacaaaaaataaagaaaggggattacttgtccaagttcaaagagccaggaactggaggagccagagtgtaagcccgggtggcctggtgccagtctgtgacgttaacgcctgcatgctgctccctctcctacagccatcccagggactatcactggggctgctcggccccaggattcacctaaatgagcaagccccttccaaaggggccatttgaagca

SEQ ID NO: 393546 - DNA, 1225 bp, Homo sapiens
aagtcactggtcacgggagggaatgaaaaatgccagcggcctgccgggagttgcagtgaacccagccacccgctcgcgtagtcttttgcgcaggcgctgtccctgttgcgcatgctcagtcttcttcgcgcggagggagtagggcggggaggagctcgccagcccgaggcgaaacggcttctgggatagtagtcttcatccactaaactgagaggcgcggagcgagcttattccccgctcccgggccaagcccagctgcgggtcccgcccgccgcgctcctccctcctaggaagagcatgagacctcacctatgaacttgccctcccacgtattgtcaagagccgtggaggactggtgctgtggtagagatgacgtggcgggcgggccgctggaaagagatgacgcgaaaacgggccttagagagggtgcggagggagcacctggcctgaaggagtcggggctgagagctgggggtttcagtcccagtgctgcgaaggctttcgagctttggaacagaatcactgaccggagactggcctactcagcccagcctgggaggccgggcagtgcccaagggagacggacgatagggagggagcgcctggatggagggtctcaagcggagtgaggaggccccgggccctgtggggaagtgggtgggggaaggtatacggccaggtgagcacccagggacgcccacagtatctggaaggagaccacggaatggagagcacctgttgcctctggagaggggacctatagagcaggaattgttaaatcatatggctgtatcacctacttttagaaataaataataggctactcgggaggctgaggctggaggttcaatcgcttgacctgggaggcggagattgcggtgagcctagatcttgccactgctctccagcctgagcgacagagcgagactccgtctcaaaataataatagtaacaatagaaataacagagaatggcctggagatagtgagtgcaaaagtgcgagctgggagatcagtgagccttttgtagtcttccaggagacaggtgattgtggcttggagcagagggaagtaaaaagtgagcaaagaaatattttgcccactttgagaaatatttgacggaatattttggagaccaaaagtatcgaactggaatggtggatgtagggctgaggacgtcgaatatgattccaagctctgcttgtggaggtgggtggctgggggct

SEQ ID NO: 393547 - DNA, 414 bp, Homo sapiens
accctaagccaacccccgccagagtgttctggggcctagggggctgtccccacttggctgatacctgaccgtggagtgattggtgcaggagaacagtggccccagtctaagagcctgataaaggagatggtggggctgtaagctctggattgcatatgaaaggtgctcttgcagttgtctgttctctctgggaattagccagccttgggagggacagtgcttgtggtgtcaacaagtccccagatatcaaagcattaaatacaacggacatctcactgtagaattggaatgaaatatgaattaaaaatgaccatctggtgattacctaaaagcaaatcacagtctgaaaccacttaaactggcaatttagaatgttataaacatcaccgaactaaactggacacagaacacatg

SEQ ID NO: 393548 - DNA, 394 bp, Homo sapiens
gtttcaataagatattgcaaagtagctgggcgcggtggctcacacctgtaatcccagcactttggagggctgaggcaggtggatcagttgagcccaggaattcaatactagcctggccaacgtgacaaaaccttgtctctactaaaaatacaaaaattagctgggtgtggtggtgtgcacctgtagtcccagctactcaggaggctgaggcaggaggatcacttgagaccaggagtttgcggctacagtaagctaggatcgtgccactgcactggagcctgggcaagactgagactctgtctctgggaaaaaagaaaaaaaagagatgttgcaaaggaggtgccctattcccctccccccatcttactgaacccttacaccacgtgtactattg

SEQ ID NO: 393549 - DNA, 347 bp, Homo sapiens
atttggtattctcaattttcttagtaaactttaatttaactgtatttgctagagaaagggagataagtttagagggcttgaaaaaggtagtaaacattttggaatggtatgaaaaacagaagtgatatctaaccaaagacttggaagtaattgctaagtgatgctaagggccaacctaagactataaacttgaaatactccaattttatgatttttaatttttttttcagttttgtttcttagcaacttagatgtaagagcagtgaaggtggttttttttttttttttttaaaatggacctaaaattagggttttgagggatacagtagggggggggaaccgggctc

SEQ ID NO: 393550 - DNA, 403 bp, Homo sapiens
tgtttcacctttggggagacggaatcccagagaggtttaggatttgttctcttcatacttaggcccttcttcttctaggagacagcttttcttatgccgtcatgcaggttcgcaaaaattacagcctgactcacataaccaggacaggatgtctggcacctgctcacccagggatccttacatagcagaacctagaggcttaactcccaacctgttactaagatggctcggccaggttggaaccaggtgataccctttaacaggccccaagggggcaggtgtggtatcagcttccagaaaggggggccttaaagagccagatctgaggtgagatctgcttctcttcctgtccagatgcccttcagtctcccattcctctgtccccactgtgaatgacctggct

SEQ ID NO: 393551 - DNA, 318 bp, Homo sapiens
accggcaaaatgggcgcactaacccatgtcctgccaaggctgcctcccagagttgtccctgagaggtctgaaggagatgtggggtgggaaaacgatttcttttttgagattgggtctcactctgtctccaaaaaaaaaagaaaaaggaagatgacctggcacggtggctgatgcctgcctgtaaccccagcactttgggaggctgaggagggcagatcacttgagcccaggagtttgaaaccagcctgggcaacatagggagaccccctgtctctaaaaataataataataaataataaataaataaataaataaaat

SEQ ID NO: 393552 - DNA, 118 bp, Homo sapiens
ccatcatacttcattaggcaacaaaagaactttaggggtactttccgtttaatcacacagaatactaaaaagacatgtacccaaggatcaagcgtcaataaaattaacacattttatt

SEQ ID NO: 393553 - DNA, 798 bp, Homo sapiens
tcacaaatatccatcacattacaatagcgtcaagtaggcatgacatatattatcagtcttgacacaatttttcttattttggctgttcaactctgcaactctgctgtagtgttacagcaatcatggatgatgcttattttaacaaataatcatatctgttccagaatattttgtatccatagactatttagaaatggcttatttcatatttaatatatacatgttagacatcaaattacattcaataggaaccaaactcagtgaggacttgaatccataccacctagaaagaacagtatgtgtggatcataacaggctctcaaatgtattaatgaatgagttgctgagaagcctgtataaaaatctaactgaattcttccatatgcaaatgtaaagtatttcctagcttattgtcacctaatttttggttaaagaaaattatatttgctggaaaatttaacagtattttgtgctgtcataagcaagatacaattctacaaacccataagccaggtggttgtagttgaaactttggaacttttttttttttttgagacagagtctcactctgtcgtccaggctggattgcagtggagcaatctcagctcactgtaatctctgcctcctgagttcaagcaattctcctgcctcagcttcccgagtagctgggattacaggtgcccaccaccattcccggctaattttggtatttttagtagagacaggatttcaccatgttggccaggctggtctcaaactcctgacctcgggcgatctacccgccttggcctcccaaag

SEQ ID NO: 393554 - DNA, 202 bp, Homo sapiens
tcagatcgggcgggcctgactctgcctcacactgttagcaactggggttggcattcatgggacgcctcctgcatgcaagaccctctcctgaggcctcctgtaagctgtggggacaccctaaccaagggcaaggccatcctgggacagcgtgtgtcaccagtggaggaacgcagcaccactcacagtgttctcctcaaaaccc

SEQ ID NO: 393555 - DNA, 429 bp, Homo sapiens
tttaaaagaactcttaaaaccacaaagttaataatttatgccagtcaaaatactgaaaagaagaagctgctgaaccagaaactggtcgtgtaatcttctgtaatgaagtctgagtctcacctgtttcagttaaacttacttccagttggcagtagcacactggacttgatgacactcaattccttcaattattttatcattttggtaattcctcttgttggttcaaaagatcatatgccattagcatataaccatagaagccaagtaagcaggctgattaggaaatcactttttccttcaaacttgttttatagccactttgagccagtttttgcagggaggagctaagcaggcaaccatcctctgagcatctaagcttctattctcccaaactatccagtgcatgcaccttgcagcagtcaagacagg

SEQ ID NO: 393556 - DNA, 410 bp, Homo sapiens
ggaccaacttcatcaatggtcatcggtacggatatcttcaactagacccctgaagagtaggatctgttctattttgttcagaacccagcatgatgctgtcctaacaaatactaaagtggtaactactctccttcaccagccctcagactaaagtccaaacagatgtaccggcccaggagccccggcagcacaggagcagtgcctcctttgaaactcagctctgcaggggagacccagggattaaaggctctgaatctgtaaggcagacagccctgcactcttgcttactgtctggggagaccttgggtgggtaatttaaaatctctgtgcctcagtgtcttctataagatggagcttttgtaaggaggaattgagtttcatgcctagaaagtctaaagtctggctctcag

SEQ ID NO: 393557 - DNA, 309 bp, Homo sapiens
caggtaggggggtgatgacggaatcaagggggggtgacgacggaatcaggggggacatctgtgctttagatcctgaccccatggagtcggagcctgcctgtgcccgcaggatcatgccagggcctcagtgcttgggtgggggccatgcatccagttcagaggccagcatccagggagggtgccaggtcgctcggctgttcggatgttgtcacaggggaacctgctggcttccgtccctgtgaatgaggcttcatgtcaggtacagtcttttggccaggaatgagggcatgagcgagtgagctgccaggt

SEQ ID NO: 393558 - DNA, 599 bp, Homo sapiens
tgaagtgtattcttaataagctcatgttggtaataagattcctcatttttttgcctttggaaatcatttagtgcatcctcacttattcaaaatatgttagtgaagtatctaattattggttgaacagtaacctctcagcactcttacttatttctctgttttctagctgaacacaggctgtggagactttgctctcaccttcattgattctccctgcttttctctctcatggttttaaatatttttttcttttctttcatgttacgcagtttgacttttatttctgttgagtatttttagttggtggtcacttttaatcacaatacacttcagcattcaagggttcctatctgatattcagtttcagaaatgtataaatatttgttattagtgtgatttgttatttgtatgtaagctagtgaaaccaatgtgtttgatttcatctcattttattctttgtacatgtacaatcatatttgtattgtgatcattttgtttttctgtagttcttttatttattcatctcagtattctagttcactaatcctgttgttattaacttggtttaataattaaaccatacattgtatattaaattt

SEQ ID NO: 393559 - DNA, 164 bp, Homo sapiens
tgtacttttgatgctgtttccatgcctaatacacagcagggataatttctgcaggctgcacaattggcctaaagtcatactgtcattctgatggtatacctgtttaattatcatcaccaacagtaataggaagccatgaacactttggctcctatctttttagc

SEQ ID NO: 393560 - DNA, 260 bp, Homo sapiens
gcgaagaacaaaggtattaatgtgtatgttgtgtttagaaaaatgcagaaagtctaaatggctgaaaagtaaaatgtctgtgaagtgggagagaggataaatgatgctgctagaaaaagatcaataacagattatgaagggcgctaagggtcatattccttttgatactgccaagtaaatatgggtttttagcctgaaaatgtgatcagatctatgtttcaaaagatgagtaatgagagaatggaaaacagactaggcag

SEQ ID NO: 393561 - DNA, 301 bp, Homo sapiens
caatccttctgcctcggcctcccaaagtgctgggattacagacgagccactgcacccagcccaaactgtacactttcttagtgtattttcctgtatgtaaattgtacttcagtttaaaaaaatttaatcctttaaacccatcagtttatgataaatgtaggaagtgaaaaattccagataagtagaatgtagcgataactcttcagactattatcgttacttcttccatattactagaaataaagctgcaatatattccaatcctagatggcagatattagcatttgaccttcttatttga

SEQ ID NO: 393562 - DNA, 823 bp, Homo sapiens
agaagattctaggtggcactcagggctcagctaagctgggagactggatttgcagtgaccccagttcttcgaggcccagttcccccatcagcccggtgctggagtggagacagcctgtgactgcgttgtcccagacagtggtgctgacaagggtgcaagatggtgccaagccaaggggaagaggaagttgagggctgtggtggaatgtcaagggtgtgatagggttgtctgtgatatccagtggggtagagatagatgggaatctgagggggcggacagtgtgcaaggaggggagagtcaggggctgaaaaatctcaggacagatgtaatggaggcgagggcactggctgactttctctccaaacccttcctttttattggcttcctcttccactgcctcccaggaccaaagccaagaccagagacccagtatgttagagtcttcttcaatggtgcctgagctcagaagtcactagaacagtgactttgttttttctctgcttatcagaggggtaggttagctgggagatctcttcctgtagcaggtgtccaaccttagagaaaatgagtggagtcaatagaaaaaaaagcatattttcacaccaacactagtacacaaatgttcatagtagctttctttgtaatggcccagaactgaaaacaacccgtaagttcagcaacaggtgaatgaatgaacacactgtggtgtttcctacaatggaatactattcagcaattaaatggaatcaaacgaccacacaccacaatatggaaaaaagcacgaaagtcagacagctgggtgctgtggttcacactgtaatcc

SEQ ID NO: 393563 - DNA, 434 bp, Homo sapiens
aatagtatattaacttaaacatacttggtatgtaaaacatacatattgcataacaactaaatatgtaactataaaaatcaaaagtgatgactaaagataaaaattttgcaagaatataacattaaaaggctcatggataaaaaatggtttggggccaaaatgaaaaaacaaggccttgctaaaaagcagaatgatactaaacttgctaaaaagcagtatgattaaaaatactgcacttgcagtaagtttcatgaatgcaagaaccttccttatctgttctgtttacttcagcacagtgactgaaacagtaggcatacaataaatatttgttgaacagcaaaagataaataagaaactgatccttgtcttcaaacaccttacttaggagataaatttttaatcacaattcaacattaaccagtgttataatacag

SEQ ID NO: 393564 - DNA, 466 bp, Homo sapiens
acccccagtttacaacagctccagttacaacagctcaagaaggtgatgttacaacagctattgtgtaattactttcattgtggctatttctcaagatgaaatttttattgttctaatggatttcatcagaaatgtgtatacggatctgctgacagtagtagtattttgttttaggatgttgtgacttagcaaaaataatacagatgtcttccccccttttgtagctttgactgagctgttgtaacagctgttgtaactggagttacaacagtcacaaagaataaaaaacgtctaaggggaagtctggaatacatcaagaacaatgtattcttcaagactcagctcaaattctatcttttatagttcattcccatctttccattttccacattttctaaaatactattaaactgtctttattttaatagtaatttacttctaagtacaaagctgcaattcagtttac

SEQ ID NO: 393565 - DNA, 328 bp, Homo sapiens
agagtgacccagcttccatgggctgggtgtttcctttgggacatgcgctgagtgaagtattttacaggtcttcgtgcagttagtcctttcagtgatcccatgaaagaggtatcattatcttcattttacaggtgagcaaacagaggctcaaagaggctaagacatttctctgaggtcacacaggtagaaagtggtagaatgttgagcccagatctgcctaactcccaggtcgatgctcccaaccatcagaacactctgcttcctcacccagtgaagaagctgggagaggaatagccgaaggggatagatgatgaggccacccacctgc

SEQ ID NO: 393566 - DNA, 889 bp, Homo sapiens
atgggggaagaggcttatttacttctgtgtactttgcctgcagtcacagttttaaaaagaaatcccaactgagttgaaaaactggccatgttactgtctcaagccacacctccggggcacttatctgccgagtccaggtgcacagcagtgtgacctcatgttctggcctgatagctcctctcaagggcttcttcaagtaagcattcatctgactttttactcagctatgtcttcttaaaatacaaggaaacaacttgattacaatagtcaatcccaaagaccgtaggccataagacccccatttcaaacagacaccgtcactagtttcattcattgttatgtatttatgagataaaggctatacacaagggaagaccaaaagatggctggtttttccatttgttgtgcacttacatttcaggcactgtgctatgcatttcacacacgttgttcttttgattctcacagccacacccaagaagtaaatcctattatgatctccttgttactcatgaggaaacagttttagagaggctcgtttcatattaatgttacccacagactggtggaaatctgagactcaaacctgggtcaggttgactgcaaaggcagacctttaaagaaatgcagacatctaggtatgattacatactatgcattaagaattaagctttaggccaggcacgatgtctcacgcctgtaatcccagcactttgggaggccaaagtgggcggatcacctgaggtcaggagttcgagaccagcctggccaacacagtgaaaccccgtctctactaaaaatacaaaaattagctgggcatggtggtacacgcctgtagtctcagctactcgggaggctgagacaggagaattgcttgaacccgggagac

SEQ ID NO: 393567 - DNA, 455 bp, Homo sapiens
atgggggaagaggcttatttacttctgtgtactttgcctgcagtcacagttttaaaaagaaatcccaactgagttgaaaaactggccatgttactgtctcaagccacacctccggggcacttatctgccgagtccaggtgcacagcagtgtgacctcatgttctggcctgatagctcctctcaagggcttcttcaagtaagcattcatctgactttttactcagctatgtcttcttaaaatacaaggaaacaacttgattacaatagtcaatcccaaagaccgtaggccataagacccccatttcaaacagacaccgtcactagtttcattcattgttatgtatttatgagataaaggctatacacaagggaagaccaaaagatggctactattacccttcctttacactccacttcagcactgtcctcgcaccggtatcctctcctcttcccac

SEQ ID NO: 393568 - DNA, 270 bp, Homo sapiens
cccagacggcccatgacaatgagtggcgggacaagtctaccagagtttcaggcccctgtgctcccaacacccccagcagtggccatcccaagtccctctcagccatcaggaacccacccaggttctctgaggagggtccagtttggctcctggttcatgatctgctgcccttgtcctagggtagacacaggctcaagatggcgaaaccccatctcttgtccatgacgagatgggccagtccacatcacaggctcaagatggagacacagg

SEQ ID NO: 393569 - DNA, 360 bp, Homo sapiens
taaaactgaggctcagaacagctggtagtttgtgaagctaagacttgaaatcccacgtctgggatgggttcttactgaaacagacacctccagtcctgctgctgtgcctgacatttgctgcttctctacctgggataaggcactggagttagaagcatggagtccacggatgagaagagtaagtttcagaaatccctttcaggaccccatcgtccttccaagatggagctgcttagatctcctccctatccttgctgtacatgcccaagattttgtgaacatgatgtgtgcgatttcaagagcaggatctggagcttccttctggtatctagactcatgatagatgctcaatacatgttg

SEQ ID NO: 393570 - DNA, 198 bp, Homo sapiens
tcagactcttccctcccttaatctatattcagccaactccactttcaaaccatgaggtttcttgctactgtttcagcctcaagagaaaggcaaggtgtgctcatggtagctttccccttgacaaacaggaaatgttatgggcaccattgtgtcctccagggtgagtgacaagtggtaattgtagtgcctctccttttc

SEQ ID NO: 393571 - DNA, 275 bp, Homo sapiens
gcaaaaatgcaaagactgtaaagatctctaaatatgtagcttcaatatgtagctattttatgggttaggatccttgcataaatctagataaaattttcaaaatagacattgaacacacacatagttctttccaacaaagaaaaaaatttccaaatattcacttaggtgtttcaagagagctgtaccaatacatcctagcatatacatccaaccactatagaaagattggtaaagtgcacacaggaatttgaccgaggactgttatgttcactatg

SEQ ID NO: 393572 - DNA, 349 bp, Homo sapiens
ttatacacgtgatctacatagaacccaatgatggggatgatactgtggcctgtacctcggccccctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggagga

SEQ ID NO: 393573 - DNA, 490 bp, Homo sapiens
cagatgatctgtgggctctctctgtgagaattacatcctccacaacccacaagattttagaatttaagtaagttaagccataaactagattccagttgacaaggattctctgaatttacagctctacaacgagtgaaaagcaagtgagttaatttattattttattttgagatggagtctcgctctgtgcgatcttggctcactgcaacctctgcttcccaggttcaagcagttctcctgcctcagcctcccaagtagctgggattacaggcgtgtgccaccatgcctggctaagttttgtatttttagtagagatggggttttgccatgttggccaggctggcttgaactcctgaacctcaagtgatctgcctgccttggcctcccgaagtgctgggattacaggtgtgagccactgcaccctgctggttatatttttaaaaggaaatttttttgagtccaccaaatggaggacatgtattatctatta

SEQ ID NO: 393574 - DNA, 762 bp, Homo sapiens
gaaagaaagtctttcaaaaaataaatgtagtatagcctaagtgtacagtgtttacaaagcatagagtactggtcagtagtgtcctaggccatcacattcactcaccagtcattcactcactcatccagagcaacttccagccctgcaagctccagttacggtaagtaccctatacaggtgtaccattttaaaaatcttttatgacatatttttactgtactgtttctatgtttagttatatttagatacgcaaatacttgccgttgagttatagttgcctacagtgtcagcacagtgatgtgctctatgggtttgtagtccaagagcaataggtcatgccatacagatgaggtgtgtgccatctagatttgtgaaagtacactctgtgatgttcacataggatgaaatcacctcataacacatttctcagaatatatgctcattgttaagcaactgataactgtagcaccgttgaaaaccatagatgaagagaaagagagaaaggcggaggttgcagtgagtcgagatcacaccactgcactccagcctgggcaacagagcgagactttgcttctaaaaacaaaaaccaaacaaaaaaagaatgacagctgtgttcttaacagaaataatggaaaccaaaagtctattgaaatttaagtcctcaaagaaagttactgtgaacccagaattctgtatgcagcaaaaatgtccttcagaaaatacagttgaaataaagatactttcatataaacaaaaacaatg

SEQ ID NO: 393575 - DNA, 348 bp, Homo sapiens
agggctgcctggatgcccgtgggtgctggtgataggaaaagtgggtggtttaaaagatgacagagtcagtgaactgctggggagagaagacacatcaaggcttttgctataggtcattgtcctgaaaaccttaagagtactagagtagaggccaaggagtaggttacagatgttaaatgacaacttctagtgaactggaaaatttaataccttatatgttcatttttttccccttaacattaagagggttgtacatttcacttagcaaattaagaaagtgggaggggatttgtaacacaaaccagaactgttttatatattaaagctgaagaatatataggattgatg

SEQ ID NO: 393576 - DNA, 120 bp, Homo sapiens
tttgaacgttggaaattatttcacaaaatgatatcttgttcctcagccagtcccgtccctagtaaatcatcttgggtgtgtgttattgttgttgtcattcttaagctacttaccatttct

SEQ ID NO: 393577 - DNA, 183 bp, Homo sapiens
tctaacaggcttactaccaggcaggtgattctatttttgccaaaaataaatctacgatcagagatggaaagtaagttttcttttcttttctttcttgagacaaggtctctctctgtctgcactctgtcacccaggctggagtgtggtggtgcaatcttggctcactgcagcctcgacctccaa

SEQ ID NO: 393578 - DNA, 338 bp, Homo sapiens
atcctcctgttgttccttgcaacttcctgatgagacatcgccatgtccacactggaaaggaagaacatgaagctccgagatgacagctggctctgacctcaggcaggaaagtgggaaccagtgggccctaaagcctccatccagccatcggccctaaaggacagtccagcattccacagtggacacaaggacctcaaaacgggggcagaaatcaacgactgcctgggaggacaacgtaaagacccgtggggttttgactaagagtgttgaatgattaggatgtgcaacaggccacacaaacggcacccatccaagactaagctcctgccatccttcca

SEQ ID NO: 393579 - DNA, 246 bp, Homo sapiens
catacaaaatatgaacactcaaaagctggatgtgatggcatatgcctgtagtcccagccatttggggaggctgaggcagaagatttgcttgagcccaggagtttgagttcagcctgggcaacatagagagaccctgtctctaaaaacaacaacaacaagaaaagaaaacccaaagagccagacggttgacccttaataccctcttcgttggggagagggaactgggagatataggggtaactgatt

SEQ ID NO: 393580 - DNA, 547 bp, Homo sapiens
aagatatttgaggttttttggggggccatttttagtggctctgatatatccaagctcttttagacactttagaatgaagagctgttctaatgttccaaaatctattcgttggtcaaaacatttggtagcatatgaagctttatacagactagggatattggaaaagaaatgtgacttttaaaatgacacctaaaacatgcattcggtgtctggtctgttaactaggggccatctgggtcaataacaagttacctcatggagaaaatgcaataggaccaaacaaggaaggaaataggaagtaactcagtctctcttgggtttaatgctaacctgctaaggtcaggcaaaatttaagtggatttagaaaccataaaaccttctagtgagatgaatgcagtgacaaaggacctttgaccagagagtcaactcttcattattcggactttaaagccatctttttggaggtgatattgtattaggcaatccgttatttactagacattgcagagcaccccttctagatgatgaggcggatatagggggagtg

SEQ ID NO: 393581 - DNA, 253 bp, Homo sapiens
ccacctcagcctcctaaagtgctgggatcacaggtatgagccaccgtgccctgtctttttattttgaccccctcttggctctaacagcacacgtgtacctctgttacaggacatcagtctacagtgctacctctttttatagtcatttatctcactaacctgtgtctttctgaaatgccagacccatgttcacttttgaatctacagtaccttctactgaaatgtagtagctggctcagtccatgtttataac

SEQ ID NO: 393582 - DNA, 503 bp, Homo sapiens
caggaccatttcatcgagtgagtgctggtgcaagttatgaaaatcccaactcagattggcttaagcaatggaaactttttggttcagataatggaagagttcaggagtagttctgttttcagatctggctgcatcaagaggcttatgtgatttttgcacattgattttgtatcctgagactttgctgaagttgcctatcagcttaaggagattctgggctgagatgatggagttttctagatatataatcatgtcatctgcaaacagggacaatttgacttcctcttttcctaactgaatactctttatttctttctcctgcctgactgccctggccagaacttccaacactatgttgaataggagtggtgagagagggcatccctgtcttgtgccagttttcaaagggaacgcttccagtttttacccattcagtatgatatcggctgtgggtttgccatagatagctcttattattttgagatagggaaaccatggcgaaa

SEQ ID NO: 393583 - DNA, 612 bp, Homo sapiens
gttagctttttttctcagatgatttaatgaaaattatggcagtctgctcattgttcagcaaaatccatttcctcttctccttgaacacaaagcttgactatgtttcctagatggcccttgcagttagttggggccatgtgactgggttctagcttgttgattataagtggaagtgatgctgccacttaaaggcttgaaagtgccactgcatactgactgagatgcagtggaagccctgtgtttatgaggtggaccccctctcaggctgaaatgtctcttaagagtcatttcagcaacctatttacttgcccaccaagagagaaattgtgactaagaaacttttatggggctgtgccattatatgcttgtatccatttgttactgtagcctatgctagtaactaacacaataataaaggtttttttcagtcttagttttctattcatttgtagaccaattgtaaatgtgaatattgtatttccattgtatcttggcttacatgttcaaagcaccataaaacagataaaaggattatattaacaagtacttaatgtagaaaagatcagtgcaagggagtctatggaataacatgcaaatatgtctctttccccc

SEQ ID NO: 393584 - DNA, 575 bp, Homo sapiens
gtactgtgtacatgttacctattcaaataataacttaaaaagaaaatgcgtaacagtgaaagagaatgaaaagggaaaaataattctcttagttttatacaagtaatatcaaagtttaacatttataaacatggtgaatgatttttaaaaattttttcaacctctaaattctatactatataacttataaaaatatggtttactacaaaaagcttggaaaaaaatagagataacaatttatataatttacatatcaaaatgtctctctgcccaaagcaataccctttgtcagaagcctttttaattagtcctagcaatttgaaataacttttaatatgagctattattaagatgacattaatataacattactagacacactctgttaacagattacaagaaatcagaaggagatatctgagaggaaagaacctaaaggttctgtatatataaatacagccttgcaaaggtacacagtattttttagtaaattttctgactaaggattcaatggtgcatgccagagttttaactaaagacttaagcataatcggaggggggaagaaaactacaga

SEQ ID NO: 393585 - DNA, 133 bp, Homo sapiens
aaaaaaaaaaaaaaaagattcataaggaatctccagggacccaaatcgccaaaacaatcttgaaaaagaagaacaaagttggacttcttacactttccagcttcaaaacttactacaaagctataataatcaa

SEQ ID NO: 393586 - DNA, 301 bp, Homo sapiens
cacacacacacacacacacacacacacacacacacacatatgcacgcacacacacaagcacacacacatttcttcctacacaccatctccttgcgtgtcttagcagcagacaggtatcagccccagacctgaggcagacacttggggatctggttcgggacagggcagacaggcatttggtgcatggatcctactgacctcccagagataactagaaacaaatgtaagaactgctgcctacaacatcttttggccttgggtgttaggtgccacatgctattgaaacttctaaaactaggct

SEQ ID NO: 393587 - DNA, 342 bp, Homo sapiens
cctcagcctcctgagtagctgggactacaggcacatgccaccatgctcggctaattttttgtattttagtagagacggggtttcataatgttgcccagggtggtctcgaactcctgagctcaggcgatctggctaccttggcctcccaaagtgctgggatcagaggcgtgagccaccgcgcctggtctttccttcctcttaaaacatgactcagaaaaaatgaaactccttggctggcactatccctggaggggctcagcaagagcactgcagaggcggagtactggggccagagattgaatttctctggcactgtcatggagctcccctgggtctcagttt

SEQ ID NO: 393588 - DNA, 302 bp, Homo sapiens
tagctaatttttgtattttcagtagagacaggatatcaccatgttggccaggctggtctcaaactcctgacctccagtgatctgcccacctcagcctcccaaagtgctaggattacagacgtaagccaccgtgctcggccagagcttttacttttgcccctttaaaatagcagctctctttgaaaagtaaatatatcacataagcacagttggcttgtgggtaggaaatgatggttgaaaaaaatgtgtgatgaaaaagtccccatagttaccctaacctcaaattcagaaattctctgaca

SEQ ID NO: 393589 - DNA, 173 bp, Homo sapiens
ttttggcagaattcacctcaggctacagtgggtttttttggggttgtgtctttgttttgttcttttgcttttttcttagaaaaggtctcactatgtttctaggctggtctcaaactgccaggcccaagtgatgcttccacctcagcctctctagtcactgagattacaggcat

SEQ ID NO: 393590 - DNA, 194 bp, Homo sapiens
tagtcaggctcggccctccttctgtggtatatttgtcttctaagtcaagttgaaatgactatttaattacgctctataattttaacctgctttgtaacagtctcatacaaaggtgcccctatgatatgctcaggtaattatctcatcaaccctcaaatggcaagtcaacctaatttccacactaattttaggag

SEQ ID NO: 393591 - DNA, 231 bp, Homo sapiens
ggaataaccgtgtgctggtttaagccactaaattttgtgagtaatttgttacacaacaatacaactattacaagatgaaacagcccagatgtcagatttaaataacctgccccaaatcacacaatggaagatttgaacccccatctacaaggtgatttgctttactgctcagtcctccctcttggcagcctctggtacaggtgaacactggactgtgggcctctgttagac

SEQ ID NO: 393592 - DNA, 3923 bp, Homo sapiens
gccgctccgggtacctgagggacgcgcggccgcccgcggcaggcggtgcagcccccccccaccccttggagccaggcgccggggtctgaggatagcatttctcaagacctgacttatggagcacttgtaacctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaatttgtcttgtctaaggtggaaatcttgtgctgtttaaaaagcagattttattctttgccttttgcatgactgatagctgtaactcacagttaacatgctttcagtcaagtacagattgtgtccactggaaaggtaaatgattgcttttttatattgcatcaaacttggaacatcaaggcatccaaaacactaagaattctatcatcacaaaaataattcgtctttctaggttatgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagcaagggtattttagctaatagaataaaagtgcaacagaagaatttgattagtctatgaaaggttctcttaaaattctatcgaaataatcttcatgcagagatattcagggtttggattagcagtggaataaagagatgggcattgtttcccctataattgtgctgtttttataacttttgtaaatattactttttctggctgtgtttttataacttatccatatgcatgatggaaaaattttaatttgtagccatcttttcccatgtaatagtattgattcatagagaacttaatgttcaaaatttgctttgtggaggcatgtaataagataaacatcatacattataaggtaaccacaattacaaaatggcaaaacattttctctgtattcattgttgtatttttctacagtgagatgtgatcttgccaaagccaccagaccttggcttccaggccctcctgtagtgagttgattgtctgcacttgccttgcccaatagccagtaggctacagcttttgccccacacccttattttcagattctggatcattcttgtttacaactgaaatatatataacctcagtccaaagtggtgattgatttgagtatttgaaaattgttgtagctaaatgaagcatgattagtcttagtatgaatatcatttaatctttaaaaaatcaagtaaaaatgtttatctgataatgtttaaataatttacaatataaactgtaaaccttattaggcatgaaatcaatcagaagagaaagaaaaatgctggaacatgcttgatgtattatgtaaaaagcatatttaaacaagggtcctcaaccctgactgcagataagaatcacttgggttacttcagatgcctaacaccttcctctcatacaaataagaattggtagctttcttaaaaaaaaaaa

SEQ ID NO: 393593 - DNA, 2783 bp, Homo sapiens
gccgctccgggtacctgagggacgcgcggccgcccgcggcaggcggtgcagcccccccccaccccttggagccaggcgccggggtctgaggatagcatttctcaagacctgacttatggagcacttgtaacctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcccctctgcctgtatgtggtagttggggtttctctcctcttagctggcattatatccctaaacagagttcgaattgagattccattagaaaaggagaaccaagataaattagtgaagtttatgatccggatcggtgttttcagcattctttatctcgtaccactcttggttgtaattggatgctacttttatgagcaagcttaccggggcatctgggaaacaacgtggatacaagaacgctgcagagaatatcacattccatgtccatatcaggttactcaaatgagtcgtccagacttgattctctttctgatgaaatacctgatggctctcatagttggcattccctctgtattttgggttggaagcaaaaagacatgctttgaatgggccagtttttttcatggtcgtaggaaaaaagagatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtacacgccctgcagttacagaggaatggaggagagactacctcatggcagcatgtcacgactaacagatcactccaggcatagtagttctcatcggctcaatgaacagtcacgacatagcagcatcagagatctcagtaataatcccatgactcatatcacacatggcaccagcatgaatcgggttattgaagaagatggaaccagtgcttaatttgtcttgtctaaggtggaaatcttgtgctgtttaaaaagcagattttattctttgccttttgcatgactgatagctgtaactcacagttaacatgctttcagtcaagtacagattgtgtccactggaaaggtaaatgattgcttttttatattgcatcaaacttggaacatcaaggcatccaaaacactaagaattctatcatcacaaaaataattcgtctttctaggttatgaagagataattatttgtctgtgagatgtgctcttgccaaagccacctagacgtcgctttccacctag

SEQ ID NO: 393594 - DNA, 946 bp, Homo sapiens
gccgctccgggtacctgagggacgcgcggccgcccgcggcaggcggtgcagcccccccccaccccttggagccaggcgccggggtctgaggatagcatttctcaagacctgacttatggagcacttgtaacctgagatatttcagttgaaggaagaaatagctcttctcctaagatggaatctgtggtttgggaatgtggttgatcaacttgatatgttggccaaatgtgccccatgtaataaaatgaaaagaagagacaagatgatgtcattttcccatattgtgaaaccaaaaacaaacgccttttgtgagaccaagctaacaaacctctgacggtgcgaagagtatttaactgtttgaagaatttaacagtaagatacagaagaagtaccttcgagctgagacctgcaggtgtataaatatctaaaatacatattgaataggcctgatcatctgaatctccttcagacccaggaaggatggctatgacttggattgtcttctctctttggcccttgactgtgttcatggggcatataggtgggcacagtttgttttcttgtgaacctattaccttgaggatgtgccaagatttgccttataatactaccttcatgcctaatcttctgaatcattatgaccaacagacagcagctttggcaatggagccattccaccctatggtgaatctggattgttctcgggatttccggccttttctttgtgcactctacgctcctatttgtatggaatatggacgtgtcacacttccctgtcgtaggctgtgtcagcgggcttacagtgagtgttcgaagctcatggagatgtttggtgttccttggcctgaagatatggaatgcagtaggttcccagattgtgatgagccatattccatacaaataggagcgtagagtgcaaaaaaaaaagtcatatgcggccctcgtg

SEQ ID NO: 393595 - DNA, 404 bp, Homo sapiens
cttgcctctagtctgaagtataacctattttgtcactattttgctttaccatctgcaccattcaatctcagcttcgtatcttcaaggtcataagcacaactgtgtaagattattcatatgactaatatgttttttttttaattctcttaaacgtgacggtcggtccaataactttttaataattcctcagtgccttcctcaatactggaaaatcctcagaatactgagtaaaaataacaaaatatctttattttcaagagcaaaagattaaaggctgggcacggtggctcacgcctgtaatcccagcactttgggaggccggggtgagccactgcacctggcccaaactaaattcttaacagcaatattatgtaaatttttgaaaactttgacaaagggaaaca

SEQ ID NO: 393596 - DNA, 408 bp, Homo sapiens
tctgtcaagtgctgttcaatgagatatccaaggccatgggcagagctgagctcagagctcagagttcctggagtgtccacacctctctcctttgtgcttcttgcagctcctgtaccccttaccctggggcagccagtatgaatgcatgaggcacatgtggggactctgcttctgagttcggatactgcatgccatcaccattatccctgaatgttccagatgagaacactgagatccagagctgccgcccctcaaggcctctaggcagagaggtggagtggaggctaagtctgttacccttcagccacccagcactgctatgccaatgggtttaccatttcagtgcctcctcactggtctaagtgacagacactgacattcacacattctcagccagggtgggtggca

SEQ ID NO: 393597 - DNA, 171 bp, Homo sapiens
caacgggaaagaacaagtcttatgtctaccacagaaaagatgatctccacagaccatcaatatttatatatagtttataatacaattaacctaactggaggtgaccatggatttatagttggggaactagtaaacaccttcaaaattttaagtgtatatgactcaaaataa

SEQ ID NO: 393598 - DNA, 303 bp, Homo sapiens
gagatgccacataccccaaagtctccatgaagcatgaaggtcatgcttcccattaaaagagcgaaactcaagctcagggactgggagtgagggcagtgacttgacccaggcctcccaggtacaaagtacagggtggagcatgagggagcctgatatgaggcccccaacgagaacctgcacctcctggaccttagctttctggtctgtacaatggatggggctttcattctgctcgcccagggaagtcagagctagagtcataggaaagtttggtcggagttcctggggagagctctttccaca

SEQ ID NO: 393599 - DNA, 388 bp, Homo sapiens
tcactctaatcccaacactttggatggcagaggtgggagtatcgcttgaggccaagagttcaagaccatcctgggcaacatagtgagagctcgtctataaaaaaaattttttttagttatccaggcatggtggtgcacacctacagtcccagctactcgggagactgaggtgacaggattgcttgagcccacgaggtggaagctgcagtgagctatgatgatgccactgcactttaggctggatgacagagcaagactctgtctcaacaacaacagaaaaacagctcttctatcttctggatacaagatcctttccagatctatgattagcaaaaattttctcccattccgtgatttatcttttaactttgatagggccttgacactc

SEQ ID NO: 393600 - DNA, 390 bp, Homo sapiens
ataatttaaagtgacattatattattgactgggaaggaataacttaaatttttagaaattgtttggggccgggagcagtggctcatgcctgtaatctcagcactttgggaggctgaggcgggcagatcacctgagctcaggagttcaagaccagccttgccaacatggcaaaacccatctctactagaagtataaaaattagccaggcgtggtggtgggcacctgtaactccagctactcaggaggctaaggcaggagaatcacttgaacctgggaggctaaggttgcagtgagctgagatcacgccactgcattccagcctgaatgacagagtgagactccatctcaaaaaaaaaaaaaaaaaaaaaaagaaatttattttggaattac

SEQ ID NO: 393601 - DNA, 484 bp, Homo sapiens
aggaccgtatacacaggcatgtgggttcagtgccctgtgttgaacgttcttagccatgcggggaaagtggtccgagccaccctctgttcagaagggatcactcactgctatgcagaatgccaggcctccaagtagaagagctgggcctcccctgtagtacctgttaaaacagaagtgctcactgaattgctttggtgattactgctatcatgatagcacttttggttgaagggtcctacagcgagttccttaattggactttgttcaggaaagtgacgtgcagcccatgttgcggagtgtagcgatgcttggtgagagcactcattatgcgctgtgcacactcttaacagctggttgctcccggggtgctacgaggtgccacctggagaccacctcacctgctccatgaaggactgtgcccagggctccctggtgtccccttgtgtcagtggggagttgctcgccgtgcttgtgataaatgaca

SEQ ID NO: 393602 - DNA, 251 bp, Homo sapiens
ctgcttcctatttcccttcttcattattctagcggagactgtcaccttcttctacttggaccgtgcattactctttgatgccaggctttgtacgctttccccttctgcttcactctaccaccccaccatggcttttcatactgcctccaggcagctttattcaagacctatatctgaccatgtggctttcctgcctaaagcctttcccattttgtgttaaaaagtcaacttcacttttaagtaaattaata

SEQ ID NO: 393603 - DNA, 139 bp, Homo sapiens
tctccttgggcatgcagggaaaatgatccattccctgcacactgccatattctccttctcagacagaccagagccttgcccttgggtccttgcccttgagattagctaggacctcctcctcttcttctccttctttctt

SEQ ID NO: 393604 - DNA, 333 bp, Homo sapiens
gtttgttgttttcatgcttggcacaagatgaaaacccatggaattgtcattgtggtgttgctgagggtgtgatcgtcattactttacaattccgtgtacttgagcctttatcttctttgtgatgagttacaaaaatggaggagtcatatttgcgttttaagatcagtatcacattggcagtagtttggagaatgcaatgaaagtgtgaaagctagaataggaaaaagctgaggaccatcgttgagctgaggaccatcgttgagctgaggaccatcgttgagctgaggaccatcgttgggctgaggaccatcgttgagctgaggaccatcgttg

SEQ ID NO: 393605 - DNA, 357 bp, Homo sapiens
ttgttttgtggatcttcagttgcttcaggccatctggatgtctacgtgcaggtcacaggggatatgatggcttagcttgggctcagaggcctgacaatcactcccagcacattccattgatgagagcttagtcatatgaccatatctgctacagagtagtttaggaaatacagtctgtatctgagcattcttatgccaccaaaattctgttactacggaagatagaatgtattttgagggaataaacagcagtgtgaactgggtgctgtggcacatgcctgtagtcccagctactcaggagactgaggtgggaggactacttgagcccagagtctaacctgggcaatatagctagat

SEQ ID NO: 393606 - DNA, 406 bp, Homo sapiens
aacccaagactgatgaggctatagactggccactctcatgtaagtgtaatcacatatttaagagaaaaagctctacaatggtacaaggcttagcctacaatgatttgaaatcaacacaattattagcaatatatcagtgaagataacacagactgcagcttttctgaaattcctagggcaatagttattcttatacctcacacttatgaaaacagatccaaaacacaaatgggtaaagctgacatttgtgttagaataactgaatctcatttatttaaaaaagtaagtcatctgcaaactgggtaacaaatttcttatggtatctcaaccatcacaaaacatacgtttgctctaacagtgaagaaccactgaattatagcagacgtaggcagtacatggtagagag

SEQ ID NO: 393607 - DNA, 208 bp, Homo sapiens
tgactgacacagggttaaattaattcttttctttattactcaaagtgatacagacctttcttggactaatgtagcttaattagtggtcaattaaaactgaacattgctgaattgaagttctttgatcaaactccctggcatgggcttgctttctttaactagccaccatcttgaattcatttggaatcagtagtataaacaagttaaa

SEQ ID NO: 393608 - DNA, 578 bp, Homo sapiens
gctttaaaagaattagacattgtaatatacaacatgcctccaaggtattattattatacgggtggcggggagagaaacaaacagtgaggagaaaagctaccttaaaaaaacaaacaaaaacaacctcacaaatcttcatgtggctgcttcagtctatggtactacagctaatatttcctcctcacaatgtttctctattttttaactgtttcctaaagaacaagtattgctttcattttattttttacttattttttgaaatggagttttgctcttgttgcccattgcccaggctggagtgcaatggcatgatctcagctcaccgtgacctccgcctctggggttcaagtgattctcctgcctcagcctcctgagtacctgggattacaggcatgcgccatcacacccagctaattttgtatttttagtagagatggggcttctctatgttggtcacgctggtcttgaactcccagcctcaggtgatccgccctccttggcctcccaaagtgcttggattataggcatgagccactgtgcctggccaagtattgcttttataatagaaaattgtatct

SEQ ID NO: 393609 - DNA, 267 bp, Homo sapiens
gatgccggatttgaggcattcgtgcttactgtgtctgtctatggacttgccaggccaatatattgatcccatggatagccagtgaatgtttgatggagtagggggtgtgtgtactacccttgatcttattccaaattcagggatgaggcactatgaaaaatgtgggagggtggaataggagcaggatttggaatctcaaagtcttgggatgggaaatctcatgttcaattcttactagcagtatgaccttgaagcaagcccctgtct

SEQ ID NO: 393610 - DNA, 343 bp, Homo sapiens
ctatgtagttactaaggagggattcagctggtggaggagatccttgcgcaaatgccaggaaggaagcccttttcctcgcatttcagtgtttcctttgaagcctagtgagggtgaagtcttttggcataggtgctccaccatctgtctattcacatagactcttcccatctacctggctatgtgccacccttgttgtggacatagagtgggtagagagcagagaccactgcttcagtaactaaaaatagatggaatttcagatcctgacagagattctctgtggagtcgctaccactgctcctcatctcctggagttagttgcaaggaacagctgtttgtctga

SEQ ID NO: 393611 - DNA, 247 bp, Homo sapiens
agactggcaattgggaaactcttggtgacctctgctacaggatttttgctggtggtggtcaggcccaaagactaaaaatgaagaggaagcagagtcacgaaatgtagggagggaagaagctaaagcagcaactagtcggaaacacagatctgagggaaggtttcctaaacacagaggcttgagcagagttagaagctatgggaaagtaacccttgaagagggagagggtgaaaatgagggaatatca

SEQ ID NO: 393612 - DNA, 140 bp, Homo sapiens
gcagagagagagttggcctgggtacttttcctctgtcgaagcccttattaggggtgggccgttggaggtggcggtgggttcattggcctcctgtctgcctcccgcgctgacgtcagctccctagtgcaggcccttgtgtg

SEQ ID NO: 393613 - DNA, 550 bp, Homo sapiens
gtaggacaaatttagttttgtttttacatttgaaaaaacaaaaaataaaataaaagatatgcctgtgtgatacattaataattcattgcttattatcttagggacatttaatatgaaaataacatatcctaatttgttgtcatatgcatgttatttcttgttcatgtaaataattcacacaagaggaaataataaaagctttctacactaattgagatcatttgaaatatgaacttaaggctgtttctatttgtaaataagttggctaaacactgtgtaaaaggtgataactagggatgcaacaatagatctgaaatgaaaagaaatccatcgtcaaggattttacaagaataacaaaagagaaagatgttcacaaataacttacaaaggcgaaatgtgataaatgctatacaagtggcagcaaatttcagaggaaaggaggataaatgtttattgggagaaatctaaaatattgttcaatccatttgggcattaaagataaggaatagacctttaacaagtaaaaatgaggaaagagcttttcagcatg

SEQ ID NO: 393614 - DNA, 335 bp, Homo sapiens
ggagaatcgcttgaaactgggaagtggaggttgcagtgagtcaagagtcgatgccattgcactccagcctgggcaacaagaatgaaactccatctcaaaaaaaaaagagagaatgacaatgagcagtccccattggaaaactatgaagaatttcaagacagcaacagcagagcattaaatggagcacagggaccctctgcccacaaggccctgggcagcagcccacaggtcgcacgtctgtgttgccgcccctatgggtccctccgaaactatgccccaaggagttaaagacgtcagggactaacagaaattcttgagtttgcgtgcgatgaagc

SEQ ID NO: 393615 - DNA, 215 bp, Homo sapiens
tcagtcctcacagctgcccagggagggacctttctagagaggaagccaggccctggccttcagtcccatgtccaggttctcacagctagtaatacacacacagctagtgctctcacagctagagcacagtcaggatttgaactcagggctacgtaatttcaaagtccgtggcacaaaggactctgtgagctggatggctcctttcacaactgctc

SEQ ID NO: 393616 - DNA, 405 bp, Homo sapiens
agacccaagtttcctgaggctgtacaagtcccagaaataatcttaaaaagagatcaagttatgatctgaaaagaagacagtctagttagccctgcctccttacatgaaatttatttaaaaccaaaattacaagatttggagcacaaagcccattgtctgctggaaatgttgttttttggggagaaatccattgttttaaaatctagtatagataggctctatttagtacctgtccgcccatgacaagatatgtacatttcacggtagggaagcctcattattgaattcagaaatacatgaattgacccacctggcctattctggtttgaaatagaaaccaacacagaaatgatcaatcttaaggggtaggataatgagacatataactagcatacagccacagcc

SEQ ID NO: 393617 - DNA, 418 bp, Homo sapiens
ctccaagctgcttggtgtgcggtaatttaatgactatttgcggttcttctgttgcatagcagagttgtatttcttgtaataactcacaagtattgaaactagggaatcgtacaaatcatcgtttggcccttgggccataaatttaaaggttaaaataacagtaaaatttctatttaatgaccacctccttttaaaaatcaatattggtttaacacctattatgtgcttagcacagaaatctatccctcaagataagcataacataaaggtttaagcaaatcagccgtagtgaaagacctaataaacttgatacgctatctctgatgaccattgaaaaagtttaaactttggtaataatctggtgttggatctgctatgccttgcgagattaattttgttctggaagatcctgttttcc

SEQ ID NO: 393618 - DNA, 473 bp, Homo sapiens
aagtgcctagcgctccctgatatattaaatataagactttcataaaaggaaattccaatttcttcttaaattattttaaaaacagaatggccttctcaatagttaaatgtttaatgcaagcaacatgcttagaaggaagaggaggaagaatttgtctgagtaattcaaaaggccagaaagagctcagtcatttgtaatcagatatttcaatacttgcaaggctttttactttggcatgatgaatggccataaaaaactatacaccttcatgtaaaagacgttggcttcctctgctctttacataatcaatttgacatttgaattttggcaaaggatcgcaggtaccttgctttatttattacctgagattagataaaaacatcactgttatcaagccataccaggcttcttcctaaaatcatgtgcaatttttcaagtaaggatcactttgtcctgacatcgaactctcccaa

SEQ ID NO: 393619 - DNA, 377 bp, Homo sapiens
cagcaagagtcttcaacagaaaaattgtaaggaaaagaatgagggggaaattggtcacttaaaataagtttaaaaggcatgcaaaaaatgggaggactgaaatgcagcctctgacgatacacgcgtgggtgatgacatcataaacacacacaaggacacaaagactgtggagccaggagtctgcttacttttggagggaggtgggtggctacaagcagaccagacacatggagtggggtgcttggcaaagttctgtgtctccacctgcatgacggttacctggatgttgcccttcccatccctcccaacgcagagcatctctttcgtgtggtgttcagtgcccatgctttattttacaatacaaagcttttctttta

SEQ ID NO: 393620 - DNA, 353 bp, Homo sapiens
caattttactgtatagcactgaggaacttgcatccacatcagctcatttgaataaacatcaatcattaccctaggcatgaaataaaccatgtatcaaaaggaagttaactaaaaggtatactcatatataatcatcttaactaagtaaggatgactaaaactttgaacacacacaatggaagagcactgatattttgccaaaaaaagttatcaggagatgaggctcctgaggtatagattagcagtgatttcttataggttttgttacacattttctctaaataacaaagaaggaaagtttgcaaccttcttcaaattctacaaggacaattactagaggctctaaatactca

SEQ ID NO: 393621 - DNA, 465 bp, Homo sapiens
atgtctgctcccatcatcttccagcgggtgggagcctgtgtctgctcgcatctcccagggtgcatgtccatggggcatgtgggctctgcactacctccagctgaccatggcattcagttgagaaaccccaggccccctagggtcactgagacatggatgtgtggggacaaaggggcctggggaacagttggcctgcgttcggtgccttggggcactggaaccatatttctgaaagtaggatgtgttatttctcactagagccttcctcagtggggaagtggtgacactgtgtccggaactggtgggttcttggtctcaccaacttcaagaatgaagccgcagaccctcgcggtgagtgttacagttcttaaaggcggcgtgtctggagtttgttccttctgatgtttggatgtgttcagaatttcttccttctggtggtttggggtatccctggttcaggaatga

SEQ ID NO: 393622 - DNA, 577 bp, Homo sapiens
caaatgttttctccaacttcccaccacccaaagcgtgtgtgtgtgtgtgtgtgtgtgtgtgtgtgtgtgtgtgttagcatctatgtagcccttctccttgacagtaactcataccactaagcacatacgtgtgtgtgtgtgtgtgtgtgtgtgtgtgatcaaaaatctaagggaagaaagtggcttccgatggagggaagggcggagtgctgaatgctgctgagaattaggaacagtgagatgaggacaggagagttcctgctggctgcagcaatatgggatttttctgtggattggcattcacaatttaagtgcaaaggtcaaatgaaagccaaattgaagaggaatgaagactcagtagggatagggaagtaaacatttatgtgtaggtagatttccagaagtttgattgtgaagatgagagaatagggctggagaaaggtttaagttggatgtattggcacacatttgttgaagaatctggcagtagcccagttaaatagccccctcctgactaggtcatgttagcttgatcgaaatgtagttcaggcaaaaagtcgccctccagcgtgaacag

SEQ ID NO: 393623 - DNA, 184 bp, Homo sapiens
aggttaggtggaaaagcagaactcttctgaactgagtggggagccagggcaaccagagctaagggagctgaagaggaaggggtccctttcagagttggagctatcatgggagaggctagagctaaggcagctggggagatgggaggccctattaggtttggtaggaaggttggggcttcagggg

SEQ ID NO: 393624 - DNA, 477 bp, Homo sapiens
attggatctgggatagctctgctgcaaggattgaaacttctaaaaccaattaagtctaccttttttttctatttcattaatttttgtctcccacggctccatcattcattgaatctaacaagatgctggacttaaaagaattagtcctttgtcctctctacttgactgcttcccttattcttgactacttccctcatttttacttgtagttaaagggctagaaacaagacaaaaattaaaccaattattttatgaaatttcttttaaaaaattcactcattcaggaaagttaactctcctttctcccagactattccaaagttgagtcaaaagagaaacacggctgggtgtggtggtggctcacgcctgtaatcccagcactttgggaggccggggcgggcagatcatgaggtcaggagatcgagaccatcctggctaacacggtgaaaacccgtctctactaaaaatacaaaaaaa

SEQ ID NO: 393625 - DNA, 222 bp, Homo sapiens
cgtgaggtttcattgtggcaccagggaagaagaggtctctgcatctgggagggccccagaggaagcagcaacattcctgggtttcagcggaggaggatgggacatgagacacagcagatcctgctctaagctggcccctgagcagtgccagaaacacatgacatgtccagctggccttgcttctgaaacgcctgtggtttagcagcagaggcagagaagaga

SEQ ID NO: 393626 - DNA, 359 bp, Homo sapiens
gttaatgagtacaaaagacatgttcaacctcactagaaatcaaagaaaatagactcaaatacctttatatctttatgcacacacaacagcaatgagtgcctaagtccaccaagacatacacaagaatgttcctattagtaaaaaactgaaacccaaaggcttatctaaaataaacaataaatgatatactgatacattcacacaatggagtagcatacgatgacgatgaaaaagaactacaccttaactgactgctttctccatagataaatttgcctgttcttgaatgttacatacatatacttttttatatctgttttctttcagtgaagattacgtctgtattatttactcatgtt

SEQ ID NO: 393627 - DNA, 342 bp, Homo sapiens
tgaacgttacagttgtggaagactcttccaacaggcaacctttgggaagtctcaggcacttcccaacagcctggccaagccactctaaaaactacactgcagggtattttcttaaaggaaacctgaggcacacctccacagctgccacaggtaattattttctcaacatgagaattctatagtctccttcccagggatccaagtctggttcccagtaatctgtgagctgaagtgggagaaaggactgaagatgccatcatcagtttgtggactgtcattgagtcttttttttttccagggtagtgactcaccacctgtttccactggccttagtattccaga

SEQ ID NO: 393628 - DNA, 134 bp, Homo sapiens
gtgttttcatgtggaccattttttattcattgggctcggtactctctggaccttttaatccagttttacatatcttagttctagaaatgttcatatactatttcttaataattttctccccctttttttttccc

SEQ ID NO: 393629 - DNA, 198 bp, Homo sapiens
agcaggattcaatagacaaacattcagctgtcatgtacctttataggaagacaatagctatctacacctacatggacaggcaatatctgaagggttgtttctgttccacttaccgagagcctgctgagctaaaagcatagatcgaccttccctacgactctctccccacccagctcaaggggtcaaagcagggaaggg

SEQ ID NO: 393630 - DNA, 410 bp, Homo sapiens
gaggtgttttggaagcaccatacctctgagactctatatttcaagactgttattttaagttagaataaaaataatactagttatcatttactgagtattgactagatggcaaagtgccaagtgctttatgtgtactacttcagacactttcagtaaggggcaattaaatagagtgttaaaggtatcatgcaaagtaggtaaatttccactccttcttatgatctcaattcagagcatgcttcatttgcaccctaagtttggtaactctagtagcacggtcctgattatgactcacctttctacgtatttgttcttcaactctccaattcgtttgtaagtccttggcaagcaagggctatgttttgtaccaggagtgactatgaagttgtcaactttgaaaaaacccaaca

SEQ ID NO: 393631 - DNA, 599 bp, Homo sapiens
tgtgggcttatgcttctccaagagatccttcaaaggaggggccaaaagagctgggagtgtgagggtacactctctgtacttcctcttcctcttgcctgcgatgtaggcttttgacctggaggtgcagcggccctcctgggaccatgaggcaaccttgacattggaagccacatgcagagacagcagagaatgaagtcagaagcagtctggggcatgaatgacacctctgaggtgccagatcagccctggactgcaaccacctgaattgattttacatgaaaacaaaacaaaacaaaacaaaaaaaacaagaaaacccttgttttgtttaagccagtggtatttctggtctctgttatcagcagaagtacaaaatttttccctctccctttttcctccccagcagtttgtcataaaacttctaaaacataaagcaaaggtgaaagaattttcagtgaataccaattacctaccatgtaaattgtattgatagagttaatattttactaaactttcttactttattataatccatatcactattcattccctatccatccatcatccttatttatttgttcatttgcttcttttctttctc

SEQ ID NO: 393632 - DNA, 300 bp, Homo sapiens
catgatcgccaatgcactccagtctgggcaacaagagaccctttatcaactaaaaaaaagaagaccagcttgaaggggcttctcttccctggctccacctgctctttccttctttctccaaggttctgtcttcaacatccaggaggatccagccttcatggctctgcagataccttcccagtgttagcattattattaccttgaggatggatattttctccctctcccctgagtatctcaagattcctagcaagtggtggtcgtctgggagtcagagacccgtgttcctgtcccagcctg

SEQ ID NO: 393633 - DNA, 809 bp, Homo sapiens
acagtgtatactggaaaaaaaatccctcttcaatggggttgaccccattcttgcttctcctcactcctcaataaaagaaaaccagcattaattagaggaaaaatgttaacaggttaagattaaaaaaaaaaaagcttaggccgggtgtagtggctcacacctgtaatcccagcaatttgggaggccaaggtgggcggatcacttgaggtcaggagtttgagaccagcctggccaacatggtgaaacactgtctctactaaaaatacaaaaaattagttgggcatcatggcaggcgcctgtaatcccagctactcaggaggctgaggcacaagaatcgcttgaacgcaggaggcagaggttgcagtgagccgagatcacacccctgcattctagcctgggtgacagagcaagactctgtctcaaaaagaaacaacaacaacaaaaataatttaaaacccaaatgttcaatcaagggatgggaaaatactgaaagcattaaaagttgaaaggttcacgcctgtaatctcagcactttgggaggctgaagcaggaggatcgcctgagtccaggaatttgagaccagcctgggcaacaaagcgagaccctgtctctacaaaaaatatttataaataaaaaattagccagacatcgtagcacgcacttataatcccagctacttgggaggctgaggttggaggatcacttgggcccaggagataaaggctggagtgagccatgattgcaccactgcactccggcctgggtgacagagcgagaccctggcttcaaagaataataatcataatcca

SEQ ID NO: 393634 - DNA, 217 bp, Homo sapiens
tattacctataatacaaccagaaataaaatgttaaaaactcaagctcatgcatacccaaggatgacaaaaaaaattctgcatgtataagaacactttacattgcattttgtaacaacttgcaaagaagataaataatatgtatgactccagattgcagtaaacagactcccacttagcttagcttttaagttatgcaacttcctcactgatgactta

SEQ ID NO: 393635 - DNA, 219 bp, Homo sapiens
ttagggaccgggggcaggactagagtgtccccgggaagcaccaaatgggatgtcaggacccctgttcccatcaccctgggggagtccatcctctcctctctgggcctcattcatgaggcaagggcctctctgcagcgtccggatgttctcactgccagtgacacccaccacaccagaaacacatctgggggcacctcactaagccctgcacacacatta

SEQ ID NO: 393636 - DNA, 770 bp, Homo sapiens
atagaattccttttttaaaaaaaaacaggcttatggagacaaagtagatttgtggtttcccagggttagggagatggagcgatcgagggagagcagcggctcagaggggtaaggtttcttctcagggtaatgaccatgttctaaaattggtgtggtcattgttacacaatgtagatatactaaaagccattcaatagcacactttatattactgaattgtgcaatatatgaatttgatatcaataaagctgtttataaaagaacagtatttaaaaaacacattgtttttcaaggtaatacattgtacttttaaaatcaaaatgcatataacatgctaacactacctttcttaaaagcaaaataaaatgaaatttagaaatgccgaagcaaggaatcattcactattcaaatgagtctttctgaatgcttaataatcataaagaaataagccagaaatacggatttaattaaaatgtttatttccaaatgtttgtagattcttacgcaggtgtaagaaataacacagaaagattccatgcaccctttatctagtttcccccatgatcataccttacaaaacaatagcaggatgtcaaaaccaggatagtgacactgacgctaagaggcagaacatttctattgccacagtattcttcatccttcccgcgcacagctaaaaccgctttcctccctccttaccccttctttaacctcctggcacaactaattagttcctcatttctataattttgtcatttcaagaatgctct

SEQ ID NO: 393637 - DNA, 420 bp, Homo sapiens
ctttgcttggcggtgcctgctggccatagtggaactgttaccacagtgctagttagcaccagtcccagcccccagacttctgaatccaactgcccgctcagcatctccactggtttaatgactcatagacacctcaaacctaaacgtgtccaaacagagctatggccttgccatagcctcccaaaccagctctgtgctaagtcttcccttcttacttcataacaactccagcctccagatgcccagccagacaccatggagttagcctccactgcgcccttcctcacatccacagccaggagagcttatcatcctacttgcaaaatagatttggaatctgatcactttcactaccctgaccacagggagagcacccccttctcttgcctggattattgcaaattcatctccagctccccc

SEQ ID NO: 393638 - DNA, 836 bp, Homo sapiens
  misc_feature (405)..(405): n is a, c, g, or t
  misc_feature (407)..(407): n is a, c, g, or t
  misc_feature (433)..(433): n is a, c, g, or t
  misc_feature (442)..(442): n is a, c, g, or t
  misc_feature (454)..(454): n is a, c, g, or t
  misc_feature (487)..(487): n is a, c, g, or t
  misc_feature (521)..(521): n is a, c, g, or t
  misc_feature (530)..(530): n is a, c, g, or t
cgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccgncncgaggactgtccccaggacatctacnacgtcatgntccagtgctggnctcacaagccagaggacagacccacgtttgtgncctgcgggattcctgctggaggcccagcccacanacatgcggnccttcaggactttgaggaaccggacaaagcttgcacatccatgattgaattgatgtcatcaccgtcatcgtagggaagggccgaggaactactggtgggaagtggccacgaacacacggaccgcttgttgtgtggggcccttccctcgcaaacgtggtgacctccggtggccgggactgtcgagccaaggacatcaagcagcccctgcaataacagtttcatccacacagggtatggcgacatgggacccccgcactgtggggctcccggacaggattgcgtacttgttttggaaaccatggaccc

SEQ ID NO: 393639 - DNA, 502 bp, Homo sapiens
atttcagtgattgtaagttcttcggtcatgtcagcccctgtcatcaacttgagttacagtagatggggcagacatggagtgtttgctttgcggaactatctgtctgttttgcttccttgtgctctttttgttctctgttctcctgttaatgaagcttttcctgcccattattaatccaaactcttgggccttgtggttaggaaattcccttaacttccagccatgtggcattatcatgtctctttctctctctcgctctctctcctctcctcctccccccaacattttctgtcaaataagtactgtttactcatttagttgcttatcaaatacttattcttggttttaaaaaaattattggtaactgtacttttcttattttttagcattattcaaatgtttacattttaatactttaaaccactttaaaattttttcatgtttaattgtagttttaagaaaaactattttgaacaaccccaaatatagtgcatctagaaac

SEQ ID NO: 393640 - DNA, 561 bp, Homo sapiens
aaacactccttttgtggaatctacaaagggtgctaagcactctatgggaatcacctcatgcaatcttcacagtgctgtacgcaggtactaaccttgcacccattggccaggtgctgtggctcacggctaaattttgtatttttagtacagatggtgttttcaccatgttggccaggctggtcttgaactcctgacctcaggtaatctaccctcctcggcctcccaaagtgttgggattacagacgtgagccactgcacctgtcctttttctagttttagatacttgagtttgttgttgttgttgtttttcttaataaaaatcagtcacagtattaagtaaggcatttaagtcaggtcaacacaagtttcaaaatattggcttgggagctacttcagtctgtatctttatcttcctgtttaattatagactggaaaaggaagacagcatttcctgcttttacagtttcctaatgatgatatctcagcttgtaatgatttaatccaaaggaagaaggcattctatctacatctacaaaacaaaccaccactattacaaactgg

SEQ ID NO: 393641 - DNA, 257 bp, Homo sapiens
gtactctttcccaaattatacctatcttccaactttactataaagtctttgaggtcaggaatttggtcttgtatattctttctatagcaataaaggaagaggacatgctaggcactccgtacttgttaatcaaggggcttaatctgcttagtacacggaacaaagatgtcagcaatcagaattttaaagagtctacacaatcaatagagaacacaatcaaagagagtaagttatgttgggggcaggggtgttctgaa

SEQ ID NO: 393642 - DNA, 555 bp, Homo sapiens
atgataacagcaatgtggttacattagagaatgtttttaattttgaaaattcatgcttaagtatttaggagtggggagagaagagagatcaagagagcaaggagaaaatgttaaccagttagtctagcaaaggttatttgagtacttattcttctattcctttaggctttctgtggattttaaaatactcaaaatgttggaaacattttaatgtttaacaattattgcatttcaaataagaaaaaggacacattagtcaattaattgtattttggcagctggaaaataaagttcttatgttcctaattgctgtcttaccccaaatgatggaatgttgaatgacaatctaatgaatgactaaagttgacagcactgcctttggaagctattactgccagaaaggagaagtgatattacaggatttgacgggaaggcaaaggaagggaagacaagaagaaggagaagaaagattttataatcatcataataacaatagtacatggtcatgcattgcttaatgagagagatacattctgagaaacatgttataaggtg

SEQ ID NO: 393643 - DNA, 793 bp, Homo sapiens
ctgtgtgagaaaggcacagtaatctgaattttacaatggagacatctaaattgcaaaattttagttgttatgtccctagtcacattactgtcatatatacgactggatctaaatgctggtattcagactaccttaatcatttttaacatcctttaacacagttactccatgtcactaaacaattgccttttaatagtttaactgtctgataaagttatacatatgtgtgtaagtgggtatttatataatgctctcttttattatcgtattcaacataattacattatagtgatattgctgaagaaattatgtgagtgacaagcatagagacccatttatttaaattctcatgagatttttctgcagagtaaggttctttatttccatttaatacagagtcctgctttgagagctggagtactgatgcaaagtgaacactgataaatcaatgtgaatgttatcgacgtcttagccactgacttgaagatgttatttctcagcatgggtgtatctgaataggacagactattaccaatatatttgaaatctctactcttaatattgaagtaaaatggggaaggaaagcatgtaaatttggggtaaagggttaaattatcaacttttccagaaatgtcatggctgactctaaagctggtgtttccagggctaatgaataatacccagcaaggataattcattgattctgatactaattctgtgctcagaaatttctccctttttatttatttaaatcatcagtctcagatccagtcaacaccttgtaactgagaat

SEQ ID NO: 393644 - DNA, 228 bp, Homo sapiens
agtgagtgctgtggtggttttaaaatatgtccacaaatccttcaacattcctccctccaaaagcacccagtctattggctggacataggggcttgtttctaatgaatacatgcagtggaggtgatggtgtgtgactagttcctaaatgcatcatggcttcctccttgattccttttggatgactagccctaggggaagctggctgccatgtcacagggacactaagta

SEQ ID NO: 393645 - DNA, 490 bp, Homo sapiens
atggccgagacgggcacattggctcacgactgtaatcccagcactttgggaggccgaggtgggtggatcacaaggttaagagatcgagaccattctggccaacatggtgaaaccccgtctctactaaaaatataaaaattagccgtgcgtggtggtgggtgcctgtaatcccagctactcaggaggctgaggcagtagacttgcttgaacccaggaggtggaggttgcagtgagccaagattgcatcactgcactccagcctgggtgacacaatgagactccatttcaaaaaaaagaaaaaagggaagtacaatatactatgcacagagctttggaactcctgtccccaggcatgttctgtttctcttgttgcatctggggaaggaaggtaggaaacggtgccctttcatcagggaaagtggtcgcaggcttatattgtccaagccccgtgagtgatgaataacgtatttgcaggcacagttcctaccat

SEQ ID NO: 393646 - DNA, 669 bp, Homo sapiens
gacacctcattttcagagtgcaaaaatagacacttggtcttttgagggaccagagctttgttctgtccctccctctcttatggtggtctttcatattcatgggtccctgaagagcagggtttccccactaccctctcatatgccccaatcctgagtgaatgcttggatgccgcacgttctgtgcaaagccgggagtagatgctgcataacccagggagggcaggtgcaagagcgttgaggggaatgagacccagaacattttattcttaaaggactcctaatctaatgcaatatgcaaaatagagaaggaacagcagaaagtatacacttaagatgcagcatccacctcacataatcagcagcatttgaaccttgtaaattccacagagatgaggcaggacaagaaagagttgctgctggatccgattgcagaggacttcttggaggaggtggcttttgacaagaaaaggatgggttttggagggttctgactattggtcagggttagccgaccctgtcctacccggctcccaggggacactgcaaggcaattgagtggcaaggagaaaagcagccccaaggcttcctcattccccgtgaatatccctgcctcattcccaactaacttgcccaactatctcagttatttccaaatctggaaggaagaga

SEQ ID NO: 393647 - DNA, 580 bp, Homo sapiens
  misc_feature (65)..(65): n is a, c, g, or t
tattactaattttcttgtttggtttactttgatttatttgattgaaccctggaagtattattttnaccagtcccacatttaaagacctagtaatcttgatggaattggtaatggcagatagggtttaatgttgttgacttttcaaattagaaaagtagttttaagtatatactatttatgatagaagaaaaactatggggtgtgtaggtataaatatataaagttataaaattgtattaaaaggcatagaaaaggcatataactaaagacatatacttagtttattataaaaaatagtaattatctttaaattgatctatcacttacagaaattttaatggaaaccctatcagaattcatggaaattaacaagctagttccaaaattagtatgcaagagtaaagagccaagaataaataagaaaacttagaagaagaataaggaaaggagcttgttctcttaaataccaagtcatattataaagctataataattaaagagatacggtattgatatataggtattaagaaaccataagatctggaaacagatctgcatatagatgggaactcagcccatg

SEQ ID NO: 393648 - DNA, 294 bp, Homo sapiens
ctttttggccacagtacaaaacacttcctatatttccatggaggaaaatggggttttaatccccaggaagcatgcttatcccccactggagacggccggtatcctttgttctatgaagcttatgtcactccatgacatgaatcacaggccaacattacagcacccaatagttatgatgttcccctccaaatttcaaataaaaccttgtgtcattaagaaaagtatttattttgcttttctcaactggcctgggactaagacagaatatgtactgctggggaatcaggtttctaa

SEQ ID NO: 393649 - DNA, 599 bp, Homo sapiens
atttagcccaaccttggcaccttctaacaaagagtaataccctcgaagtatacttcatttactactgtttctgctttatattacccctcagcatctcgcgcagaagaaagcaaagggaagcaatggggcatctgattggtctgggagctccagatagccagcaggtacttgaaggctgcaagccagcttgagagcagtggctggaactggaaggggtgtgcacactaccaatagcaagtgagcaagagagacccacaataaactgaaggttattacagtactacagtaggctctaagaaagtcccttctcccactttaagaaacagggctttttttttttttcttttttacttttaaaggaaacaattcatttgctagaaaaacctaaaaaaaaaaaagattatatacaaaatggttgtctgaatgtggattttatactgcagcaaaagcaacccagctctggaactctattcggcttcctcagttatcaggtacatcatgctgctgatgaaggtgaaggcgaagccacccacgccaggatgtaggagtagccatagctgccttctttggtcaggtaatagaaatccgttgtttcatcg

SEQ ID NO: 393650 - DNA, 351 bp, Homo sapiens
gatagagacctcctaaataaagtactgattgtatttcttcactgcaaaacagacagaaaaacatattattaaaaatatgtcatttattacaaaaaaattagtgaggcatggtggtgtgtgcctgtaatctcagctactcgggtggctgagggaagagaatcacttgaacccaggaggcagaggttgcagtaagctgaggttgcgccactgcactccagcctgggtgacagagcgggactcctatctcaaaaaaccaaaaaaatgtcatttgtgattccatcgagatgtgccaaattcaaagagaaggaaagtagaacagtggttgccagaagcttgaggaaagggagaacg

SEQ ID NO: 393651 - DNA, 574 bp, Homo sapiens
tgacccaggaggtgcatgggtggctgttccctcccagcccagtgccacctctgccatcctccctggctgggaaagatgaactgcgcttaaaatgggctcagttttctttttcctttctttccttcctttccttccattccttccctttctttccctttcttttcatccttccttccttttctttctctttctttctctctctctctctctttctttctctttttttaacctagtaattgcttttcacatctgctggtgggctgctatctttcataggataacttccattattgctttaaataaggtggtgtttggcctctgttttgttttcaggtaaagcaaactgcaatcaggaagcctcattacagacagtgaggtcatgacaagaaaagttcattcacactggagagttcaaccccattggaaatgtctttccaaacacagctggtgactttgcaaacccagacattcccagaaactcagtggttccagaaacttgcttggaataattaaggttttagagcagctgttggaatttttagaaaggaaaaaaagaaaaaacgaagtgaggctc

SEQ ID NO: 393652 - DNA, 216 bp, Homo sapiens
agtgaaactccgtctcaaacaaacaaaaaaaagagcatggctctgggaatctgactaaggtgggctctaatcaggctttgatgtctgctttgcccaagctcacttaggcaaattacttaatttcttcattcttagttttctcacttgtaaaactgggataataattgcacccttctcataaggtagttgtgaggattaaattagataatacacata

SEQ ID NO: 393653 - DNA, 1091 bp, Homo sapiens
gacgtctgacgtcaccgaataatcaaaatggtgacaattgcatttagctggtcacagagatagatccctaaggttatgtcaataccactccatgttctcaaagcccccaagaggcaggaatctaagtgaaataaaccagcaagtccttgtctggacttgcaggagagaactgaggggctgcctgaggctctgtgttcagcgcctcacctcggatgatcttaggatggtgagggtcagtgacactgcaagccatgagtcctttggcagtgggtccgtggccctgctgaatggcaggcgcatggccaccttcctgaagattgcaaattggaaacagggcgagtctccacgataacatctaggttacagcattgtaaaatgtccccaattatcttgacaaatggaagttggtgtgaatgacttatgaggacacgatatttttgtagagaagggagagttccagcaataggaacgagctgtgccttgctcttgggaaaccccaccctgttttgggggccttaggttgctatgaaatggcagggtttgattgctgttgatagcaggaaagtctgacccatgactaagggaataaagtagagaaaacgcaataagcagccatcccagaaaaccagtgctcataaaagtgcttgttactggacactgattttggcttcacattgactacaagtggacctaaaccagtcagtaaaatggtgttagctgctttgttgtttcatgtatttattcgatacatatttattgaatgcatattgtgtgaagcgttgttctaaactctggctataacaaagtagaaaaaggaaaatccctgatctcactgagtttgctaaataaatataaattcattttgacctttgcatatttctatgtgagtctagcaagtggtcctgggatggaatgaagtacaacatggatatggcacatcagtttatatcctgcagactcaaggattagagaactctctaaaatatatccggagtaccactgaaagctacacatctgtttttttggtaaattcaaatcaagttacaatactctttatacaatgtgatctcattttgctaacctatatatac

SEQ ID NO: 393654 - DNA, 777 bp, Homo sapiens
gcccttggcaccttgaacttctatggacaggaagcagactgaggaaactacttggcaaacatgggctacattttatggaaaaggaaagaaattcaagaggatggaatcaagagcccaaacgggaaccaaaagctaatcccaggcagtacatgtgggctgggtgcagtggctcactcctgtaatcccagcactttgggaggctgaggcgggtggatcacctgaggtcaggagttcaagaccagcctggccaacatggcgaaagcttgtctctactaaaaatacaaaaattagccaggcatggcggcacgtttctgtaatctcagctactcgggaggctgaggcaggagaattgcttgaaccaggaggcggaggttgcagtgagcggagattgtgccactgccctccagtctgggtgaaagagcgagactccatctcaaaaacaacaaacaagaaacaaaaataatgacaaccttgtgcctcatttgatttcagaattgctatgaaccggtggctactttgttcctctgatttttcccttttttttttttttttttttgaatgggactaactattgcctgccctttgttttacctatgttgtattctaggtatgtgtggacagataacttgtctctttagttgataggtcttcaggtcaggatgaactgcactcaagctgaactcaaggaactgcctcagaggagcttcatctacctttgtacctaactttgatgataagatctttgaacctgaggttctaaatagatgaaacttttgg

SEQ ID NO: 393655 - DNA, 206 bp, Homo sapiens
tcaaactcctgacctcaaatgatccacctgcctcagcctcctaaagtgctgggattacagatgtgagccaccgcgcccagcctgactctcattttcagtccttggccagagatctccaaccctgccctgcaatcttagtacacattccttgtttggggtcttactctccaaagtgactacatcatattccctctctcctcaaatct

SEQ ID NO: 393656 - DNA, 822 bp, Homo sapiens
acaggcaggagctactgtgcccagccagatttgctttttagatccttctacatttgtggggaaactggtgaactctgaattgaccctggtgatcagttaatagtaagggaccagtgttggtttccaccaagctaccctggaaatgtaagatgttaccattaggggaaaccaggttgggggactccctatgatcttcgcagcttttcagtaaatctaaaattattgcagtaaaaaacagtaaaacatctggctggctggcagaaggggaggcagcctctgtcctgcgtggctgtcccagactggctggggtggcactctggctgtccctggtcagtccctaactcaggctgccaaagacggtcgccagtctagggaagaagcggcccaacgcgctccccaaagacgtcgctgcaggcacagggtttaggaagaacttttattttcttccttctgctgctgtgggttttaatttcctgccattttcataattaaaaaaagaagtgctattttagcacgaaacaatgtttctttagccaaagccagagtgagtgggcagcaatggccgcgcgccctgctctgggtggtcccgaccccggggaagtccctgtgcagaacgggggctgcgggggcggcaggaggaagtgggggcgcggcacccaggcctcgctgtcttcccttcgagggacctcgcgctgcaaaatccgaagagccggctggggcggggtcgcggggtgcgcgggaaccggggcctgggacgggcgggcctagccagggcctccacggaagcgaggccaggactggggagtggggggtgggagggtc

SEQ ID NO: 393657 - DNA, 844 bp, Homo sapiens
ccagggtggaaaccatttcattgctgctgggctcctggggcctagatcattgtctgagataaaaataaccgctactttgaagacttactctcaggaccaaataggatcatagctgtgacaagtgttttgtgaccacagacagctccagctctgtgccgttactaggatcctgggctgatgagaaaccatctccagctaagagattgtgattgaccactgagtagctgcccaagttgagacgctctgctcagcccccagcctgacaggacaattggcccacactgccccggaggctgctgggcaggagctggtaattgacagagaactcattatcgaaggacagagcctctgagcatgctgggaattggaactgacagagcccaagggcctgggaatcggatcactgggaagagacagcccaagtgttgtgtgtcctggacgtacagaggaaaataaagtttcagaaattgctcggcactaaaagagagctctggtattgaaagccatctctgatccgctctccatgtggctttgggcatgcaattgacctctgtgagcttcagttttgtcacctccaaaatagagatgacaataaatctttttcgtggagtaagaaataaggatgctgtaactatgacattgatgatcatcattataacaactagcagctatttcacatcctccagatgccagagaccatttgaagagtgctaaaaatgggccaggcacagaggctcacacccgtaatcccagcgttttgggaggcccaggcaggagggtcgcttgagcccaggagtttgagaatagcctgggcaacatagtgataaccctccatcactacaaa

SEQ ID NO: 393658 - DNA, 571 bp, Homo sapiens
ttgagacagagtctcactctgtcacccaggctggagtgcagtggcgcaatctcagctcactgcaacctctgcctcctgggttcaagcgattctcctgtcttagcctcccgagtagctgggactgcaggtgcatgccaccatgcctggctaatttctgtatttttagtagagacagggttttactatatattggccaagctggtctcaaactcctgacttccagtgatgtgcctgcctcggcctccagtccagattttaaaatcactcattatactgccaccacaaagtaagatttaggctgcgaccagaggaatgcataagaactagaaggtaaagtatgtatgtgggtataggtgggagagtatatgtggaaaagggggctgttacatttgagaaacaaagaaggctagggtggctaatgtacagaaaatgagaagtaagatggaatgggatgaggctagaaagatggttcagggccccataggctattaagaattttaaacttttatctgagggggaaaaggaacctgaagaaggcttttaagcagaaaagcaatatgaacagatgcag

SEQ ID NO: 393659 - DNA, 440 bp, Homo sapiens
tcactgcttacgacggctgaccccaaccctgcattgcaaaacacttggccccctctgactatttgaccttccctttggttatttcccagcacaaactcagtatcacagaagaaatctaccgccttgtagctttagtactgcaaccctaaagttacagagtgcggttccgtgtggtcccccggtttcccatgagggcccgtcgggatgcagagggagcccaaaggagtgctgtgccgaccgtgaccctcccaggcccaactcagaggggaatcccctatttgagtgacccccagctccagaccagcctcctgcagggggactgttcctacatacagtgctcacctccttcccagaattccttagcggaatcctgcaactgtaaagtaacgaggaacagcacattatgactagaggattggcgtggtggcacttgaagagcc

SEQ ID NO: 393660 - DNA, 206 bp, Homo sapiens
attaaaatgaaaagacaatattcaaaataatgcaacaaaatgaataaaatcctttgtccaatactgtacacataatgcagaaatcagtgcatttttcttaagcatgttttaaccttcatttagttcatactaaaatataataggctttaaatagctcaaataatattcagcagtttaaactgtaaacagcttgtttaactgttaag

SEQ ID NO: 393661 - DNA, 612 bp, Homo sapiens
  misc_feature (63)..(63): n is a, c, g, or t
tctggactttacagatgccgggatgccttcatgcaaagctcagagctcagtgagcatcagaanattcattctcgaaagaacctctttgaaggcagagggtatgagaaatctgtcattcatagtgggccattcactgaatctcagaagagtcatactataacaagacctcttgaaaatgatgtggccaaattattctctatttttcttccagctcaagtctaacccacttggtatttctttaagcagataaagcgttgttaaagtaaaccatcgcacctcacataggtcagtatattgaaatgatttaggaatctttaaaatatattgatacctgggtctctatgcccagagactgtgatctaatttatctgggaatgccatgaatatcaatgttttaagaattccacagtaaaattttcccagatgatgtgaagcagagcttctaaactgtccgtgataatgacgtaggcatgaattttaactcaggattcattggaacaggcatctctgggtaacttagagtagattttgttcccagagtctgtttctatcagaacccaacttttgtaggctcagaaggcagagctgagcaggaggtggcatcgataaaca

SEQ ID NO: 393662 - DNA, 845 bp, Homo sapiens
atcaatattaatgagacagtttgaccaagtaactcctgctacctaggcaaaaaggaatctagtgacaatgtataatgagaccatgtaagatcctttttctattttgattcagaaaacatctataaaataccatgttcaaattaccctgctaagctatcttcttgttcttttgcttggtatatctgctaaatggaaggcattcttggttcagtccccatgtaatgggctttgtacatcctgtttttaaaaaatggtttttaaaaacaaacacaggtaatctctaggaataaggcattacagtctcatgctagatctttcctggtgccagctttgtcccctccagctatttcacaattagacaagtcaaactctctttcttgccctcagttttctaatcattataataaaatgatgtggccaaattattctctatttttcttccagctcaagtctaacccacttggtatttctttaagcagataaagcgttgttaaagtaaaccatcgcacctcacataggtcagtatattgaaatgatttaggaatctttaaaatatattgatacctgggtctctatgcccagagactgtgatctaatttatctgggaatgccatgaatatcaatgttttaagaattccacagtaaaattttcccagatgatgtgaagcagagcttctaaactgtccgtgataatgacgtaggcatgaattttaactcaggattcattggaacaggcatctctgggtaacttagagtagattttgttcccagagtctgtttctatcagaacccaacttttgtaggctcagaaggcagagctgagcaggaggtggcatcgataaaca

SEQ ID NO: 393663 - DNA, 477 bp, Homo sapiens
gaagcagaagatgagcaaatcatctgcaaataaagagtttccactgcagtgaatgctgcgaagaaaatgaaccttcataggagagctgaaaagagagaggcaatcaaactgggggcctagcacaggtgctctgttgttgtgggggatacccctggcaaaaggtctgggaaactgagtcactaatgtaaggcaaattgctatttgctctgagattggcctggtgggggggcagggaggttaagagggggataagaaaatggagcgagtccatatctttcttcaaaacagggttttgcaaatctgggaaagatgggagaccatttggaatcaatttagcatttagagaagaggcaagtgtgcaaaagaagagtgagttggcctggagtgaagaagcagagaggagatgggaaggaagaatgtgccttggtcctggccagcaaggcctgggagccacgtaacacaggagatgctggtggc

SEQ ID NO: 393664 - DNA, 391 bp, Homo sapiens
tagaaattcatctgatctgtagttggaaaccacctgtaactctggaaggcacatctctgatttagtatgtttgggagtctttgaaaacatgggcctctgtatcagtattgcggttacacggaaattcttaccttattccgtcatgtattgggaacaatattgctgttactacctccctcaagaaaaaggcccgctgcccagatgctcactttatataataatgcctttgcctagaatttgtagtagtaatttaaaacacttgatgaaattgtagtctcagcttttttgagcactttgcatttttaactttatttttgtatatttttgagtgtctcaactttttagctaaaggaaaatgtttttaagtttaaggatataaaaatccttaaaa

SEQ ID NO: 393665 - DNA, 438 bp, Homo sapiens
tttggctccatactttttcttaaaatgtgctttatttgcagagacagtaaaggtcaagagttggcatatatacaaactatcacttaattaagtaatattggttgcagtcagtgattgttggttttgagatagaaataatgtattataatcattgaatctaagagaggactaagcagaatatgaatcaaacacacttctatgtgagcatgccactgccctcagttcaagtggaatctaattggaaatgccaaaactttactgttctattgcatatttacatggtactaatgccatgcattttattctgctcaaggtgccctcagggagataaagaaagcagaaacggtcagagaagcaaatttgtattaaggcacttaaggcatcttgccaccactgggtctgggaggcgctgctcagtctgccgacagcatcttctgg

SEQ ID NO: 393666 - DNA, 599 bp, Homo sapiens
gcctctcctggatttgattagaagataatgtgaagtttttgagggtgaagttctgaatttgttgcctggaaggcatacatgaaggcatacttccaggtttattggaggatggggttatgaatgatgtggttttaaaacctttgcgatagtctggacgtggacaaaggtgtgtctgtgggcacatcttccatcttatgcccatagtgttcttaattttgtctcattatagaaggaactctcccactctgggatttctgtgtttttggagtttaatgggaaaaaaaattagactttctcagatagtgactgaagtgagatgcttaggtgtgatgtataagtgaaaaatttatgtttttgttaattactctcctgattagtgattttatacccttcccctctttttctcattttctttttactgaaatcttttatgtgcaaagtaattaagaccttagtatttagcatcattttatgagaataaaaggaggcgggaaaggtcagaatcaaaatgacatgttgggaaaaaagtccattgtaagttcatttaaaaatgagtattggccgggcgcggtggctcacacctgtaatcccagcacttt

SEQ ID NO: 393667 - DNA, 435 bp, Homo sapiens
atagatgagggctgtgctgcaatgacagatagggttgtatgaaacatacactaatctgaccattctatcctccagactcagggaaggaaataataaaagtaagtaaccataaaaaatagacttttatgcataaataaataaaaatcagctaggagacagttcatccctgtataagtaaaacaggcaaatttatctttcctctgattaataatttaagaaaaaatcccaagcaagctgcctatggaggtgtaggagtagctcctataattagactccaatttgaaccatgagggtgaggatcagaaagctgactcagagcctggtgtcaattatttgcagtttgtacaacgaaaggctaaaaatttgggagatgcaggatgactgaagcccgattctgggggttgttacagcacagttacagggtaagttttttcc

SEQ ID NO: 393668 - DNA, 568 bp, Homo sapiens
ttccattttaattagagagtaactgactcctcagaaatgaatatgctaatgaatggcattgccaccagcacacatttaatcaaagcacccttttagcacagcgtaggcttggttttgtgtcctcactggcactgactggactctgtgggatacacccgggcccctttggaccatgcaggatgtactgcaaaatccctcagcccttatgtagagagcttgcacccgatcgggctggaaactgtcaggacagcgcaggggcattagagagacagggagacggggttctctatcaggagtgtgaaggatgcacacagaagctggtctgatgcaagatgacacaggccgagtggtaagtaatgcaagaagagggtcccttacacacacaccgataattaatgttgtcagtgattgctttcttcagcagcgaggtctgaattaaaaagggcagtggccccaggcagccattatcacagtctcttactgtaagtgttacggtaaattggtattttccagccacaggctaggcgctggtgtctttttttgtggaagtacttaatctgtaatggac

SEQ ID NO: 393669 - DNA, 318 bp, Homo sapiens
cctcggcctccccaagtgttaagtttcttgaagaagctgctttactatttctgaatgtgccctctattcctacatataattttttttggaataatattggtagaactgctaatttttaaggagtaacttgattctttatactgaaagaaatagatacattgaattcagctaggaagttttgcaatttttttattgtaaagaaaacttacttggtaagatggagtgaaagcaactcaggataaaattaggaaagggatcataatggatacatctttgaaccctaaaagtaatgaatcaaatcaaactaagatttgacat

SEQ ID NO: 393670 - DNA, 345 bp, Homo sapiens
gtggggagctcaaggcatcctcccggcaggtcatcctgggctcccattgctccccagaagtggttccagcttttgtccctctacctcccagtctgcccctagccacaagctggcaattcagttcaggatccttcctgcaggaagggctacaagtgtgctgacactacccgccatgtcccagccatgggaggagatgactcaggcgttcccccattaacttcagagggtccccaggtattatttttgcctatcctccagctagaagttaaaatgcaggaccttctagccaatagggaaaacaggtatactggccgggcatggtggctcatgcctgtaatcaccata

SEQ ID NO: 393671 - DNA, 223 bp, Homo sapiens
agaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttc

SEQ ID NO: 393672 - DNA, 304 bp, Homo sapiens
ccttgggatcttgcccacaaggtactattgcaactcgcatgggctaactgcttttcctgtcacccgttactatgcctcagatggcctaatcacacccaatatgtggccctcccacccaaacactgaggcaactatagctaaaaacaaagttcgctgaattttcagttgatgttgaacggtcaaaagctttgggccactatctattaattcctgacttgagaaacacaagtttaaaaaaaggagccataacaccacagaaccaggagacactctgaaaaggtacccactgtccctgaacagaagc

SEQ ID NO: 393673 - DNA, 487 bp, Homo sapiens
tcataagtcccactttacacaagcataaagtaaacttcagaggaaaatagtatctttcagagcttctcaattattcactgtcatgcaataaaatattttaagatatacaaaaaaaggctgggcgcagtggctcatgcctgtaatcccagcactttgggaggccgagatcgtgccattgcactccagcctgggcaacaagagcgaaactccgtctcaaaaaataaaaaagctgggattacaggcgtgagctaccgcgcctggccagagatatgttctaagaaacgtgtcattagacaatttcattgtacaaatgttatagactgtacctacacagacctggagggtataacctactgcatacttaggctatcaggtatagcctattgctcccagactacaaagctatacagccatgttactgaaaaggatactgtaggcaattgtaacacaatggtacatatttgtgtaaactgattggggatcctct

SEQ ID NO: 393674 - DNA, 347 bp, Homo sapiens
agtgctgtgccgctacatcggctcacagcaagctccgcctcctgggttcaatcgattctcctgcctcagcctcctgagtagctgggattataggcacccaccaccacacctggctgagttttgtatttttagtagaaacagggtttcattatgttggccaggctgttctcaacctcctggcctcagatgatcttcccgcctcagccttccaaaatgctgggattacaggcatgagccaccatgcctggccacatttttaagtatttactttgtcccaagaacttcaggtgcttgatttaggtactttactcatattatctcattttatctttatccagaattaccag

SEQ ID NO: 393675 - DNA, 215 bp, Homo sapiens
ccacacagaattgattggggtaataaaatgacagcaccttgtaatatacggaaggctttttaatttgaaaaccagttctaacctgattcaaagcttgtttaaagctaatttatagcttacataattttcagctggctgaccaaggtaaaggatgatgtatgaaaactgataaagaattaatattcagacattcctcgttaaagttaactggtatt

SEQ ID NO: 393676 - DNA, 275 bp, Homo sapiens
atggtgaatattgcttgatgtctttcatttgaatttggtgttggatatgtctgtgcctaggatgttgaagacaaaagggtggaggaaatgttgtaggttaaaatgggaagatgttttgctaaaacactgtaagaagttggaatataaacaatatgctttggtatcataatcacagtgcattgcacaaagagaaaagtggcattttccatcgttgtactttataactttgatgtgttgcaagctatagtgcatccgtggtggtacctggcaggaat

SEQ ID NO: 393677 - DNA, 368 bp, Homo sapiens
tctgttttcttattacttcgtttgatggttttgtatattctgaatacaagtcatttatcagatatatggtttgtaaatatttttatcctagtatatggcttgcctttcattctctcagcacagacttcttaaataacagtttttcattttgatgaagcccaatttatcttctttcttttatgggtcatgcttttggagttgtagttaagaaatctttaaccccagaatccttgactaactccagatgacaaagatttttctactacattttcttctagatgttttacagtttggagttttacatttgagtctatgacatgtttgagttagtttgttgcaaagagtgagagggaggttcaaactcctgt

SEQ ID NO: 393678 - DNA, 325 bp, Homo sapiens
tggtgggtctttatcttcattcattaatcacattatcagacattccctgtgtgtcctgttctgttatacatgctgaagctacaaatcaaacatccgctttgcctccaacaagattccctgttcctaagtgaaccaaggaatgaggtgttccacgcctgagctcacatcttttttttttttttctgtagcccaggctggagtgcaatggcgcgacctcggctcgccgtggcctccgcctcgcgggttcaagcgattctcctgcctcagcctcccgagcagctgggactacaggcgcccgccaccatgcccagctaattttttgtat

SEQ ID NO: 393679 - DNA, 245 bp, Homo sapiens
aggcactttttcagttagcataatttttgcttagtgtttgtattttataaaaataacctctctttttggaatatgtgtatatgtaaaatatatgggatgtacatatattgtgtgagagtcaagtatttttggttaagtcagcttcctattctgccaaagaaaagatcacaaaagacagttatacttctaatcatttggaccacgtttatctcgtttgttgattaacgaggctcttctatttgtat

SEQ ID NO: 393680 - DNA, 348 bp, Homo sapiens
ttgaatttggtgggcttattatactttttatccctcaaagagcctggcacaagtgttaagcacaggtgatgttcagcagatatgtgttgattcaacacctgccactgcagctatctctgaccctgtgtggagcaatgattggcagaacagactgacacttggttatcaggctgtttccataggcacagaacaaaaacaagaagatagtatccttgaaaagccagtcatagcctcttctctatacttgcagtcctgcacataagggacaacttggtgagcagagtgtgagccgaactccaactccactcaacctttggctggtgttattgctcagtgcacaatctggac

SEQ ID NO: 393681 - DNA, 147 bp, Homo sapiens
actttaaaaattaagtcccattcacttatgtaaaagcattcatttaatttcatctttcagctttaataaaaaatgcgatactacaattgaacaaatatccaaacaactataagcattaacaatgtacattttaggtcggggtcccca

SEQ ID NO: 393682 - DNA, 294 bp, Homo sapiens
ccgactgtggacatgcaccctggacctgtttgtgactgtgaacccatggaggaggaggtggctgttgagggatccatttcctgtccgggctctgatgccgtgatgcgtgtgcgtgcatgacactgtttgaatcagtgtctggtgtgcggtggttgcgaccatgaccctgtggaatatatttgtatatgactgtgttgtgccaggtccctattgaagtctctgctcgtgttgtgtcccagtgaggctccgaggctgggtggtgtttacgtgatgggctgacactttctctatttg

SEQ ID NO: 393683 - DNA, 485 bp, Homo sapiens
cagcctcagtggcccctgacgatcccaatccctaccttaatcctgcctaattggtaatgtgcccatgtacccacagcaggccaaaggagttagcatgcccaggggcaaacaggagcattgtgaaaccctgttgtgtacatgcataggaacacattctggcaaacacaatatgggtacacacgtgtacaaacacaagtctataagccatggatatgaatatccttcagtgtggtgtacatatactatatgtatgtcgtaagccatgtacatgagcatgcctgttccttgaacataggtgcaaatcctctgtgtgtagatatgtaaatcgtctactgaagaatgcccaatctccagtcactcctgtaaagctagagtgtatgtgtataagcatacacctgtgcactatgcctgtccatgtatgtaaacccaccacgtgtttgtaagccatgtacatgagcatgcctaattcccagacatctgtttaa

SEQ ID NO: 393684 - DNA, 494 bp, Homo sapiens
  misc_feature (419)..(419): n is a, c, g, or t
ttaatttttcaattattcctgttgtaagggaactagtaggatcttcatttctagaaagatttatattgctaatttagggtgtcctgcacagtgctattgctggaacccaacatcttttccagcctcagaggagaccaaagtggacagtgttccagttaggggggaaaatggaattcacaagggcatggtggtatagatgatggcagcttcagggtgggggaagtgacaagctggacatgtgggctgggtcctgaggctgcacagccagaaggagcaaaccaaggaatttggactttaccctcagggtcaacaaagccatcagaacctacgaataggcagtggaatcttcatatctggctcttagaaaggttttctggtgacagaatggaaactagattggaggtgaaagatatcaaaanccccaccagcactctggaggctcctgtcgttccagtaccttcctatttgtgctttaagccaagaggcagtaacag

SEQ ID NO: 393685 - DNA, 373 bp, Homo sapiens
cccttgcctgcctcaggccaccagctttgtgcctcttctctccctccagcccttgttcctcagcttcttctgaaaagctttccttgagcaaacccagctccgccttgctctgtctggcgttgaatcattaaatcagcgacgatttggtgacctcgtatatactcagaacatacctggagctgtgaggggaacaggagcaaaccacaggcagctccctagtgaggcgagtgcagtgtcaccaggacgtgctgcttggggccagcctggtgtggccagtgccttgcattgtatgcggagctgcgagagacgagacatctaccaagagtttctgcgttaacatcactgttggctcttcatagctgagcaaagcaat

SEQ ID NO: 393686 - DNA, 858 bp, Homo sapiens
agacaccatcaagggtaccaacatatgcaacataggagtctccaaagtagaagagaaaaggaaagaggcagaaaaaatacagtgttcccccattatcagcagttgtgttttctgcactttcagttacctctgggcaaccacagtccaataatattaaatggaaaattccagaaataattcacaagttttaaattgtgtgtagttctgagtagcatgatgaaatgtcattctgccctgctctgcccacccaggacatgaatgatccctttgtccagcatatccatgcagtatacactatctgcccattaatgtacaggaaaaaacatagtgtatacagggtttggtactatctacagtttcagatacttactgagagtcttggaacgtattccccacagataatgggggagcaggagactactctatttaaagaaataatggctgaaaactttccaaatctaattaaaggaatgaatctacacatccaaggagctcaacgaattccaagcaggctatatgccaaaagatctacgctaagacacattacagttagattgtcaaggcatagacaacgagagaattttgaaggcaggcagagagaagtgactaatcagaatcaagagatccttaataaaattatcaggtgatttctcattagaaactaaggaggctcaaaggcagtggggtgacatatttaaatgccctggaaggtggaaaatacctggcaaccaagagttctatatgggacaaatctatccttccagaataaagcaataactaagacattctcagatagacaaaaattgagagaattctttatcagtagaactaccctaaaagaaatgttaaagaaattat

SEQ ID NO: 393687 - DNA, 792 bp, Homo sapiens
ctctttagaaaatgtgtggactccaggcaaagtgctgggattacaggcgagagccactgcccctagcctacaactttaataagccaattttttttttctgaagagagttattaattggttttattgtattctccaattatcgggtgttacagaattcataatattgataagttagtctgggttgaaacactgtcttccacagtatttattgagtgtgtattgtgagttgggctttcttcttttgatgggagactagagtcttatttgaggaaactgacaagatgatacttttttcttagacctctaggtgaatctgatgttccaattgcttgaaaggagtatcagattcattctaggtatcttgatctcctgagactgaacctgtttggaagattgtaatcttgaaccatttctgacaggtaaatatgcaggttgagcatctcaaatctgaaaattcaaaatctggaatgctccaaaatccgaaactttttgagtgccgacgtgacagtccaaggaaatgctcactggtgcatctcagactgtagatttttggaattcgcatggtcaaccagggtaaatagaatgcaaatattccaaaatccaaaatatgaaacactctggtcccaagcattttggataagggattctcaacttgtactttgattcctagatcatagctcatctgatattaattgtcttgcattttgctgtaatgattttttgggttatttgttttttagagacagggtcagcaccataagacagagtgagaaaacaaaagtaaaaaaaaaa

SEQ ID NO: 393688 - DNA, 367 bp, Homo sapiens
tccagcctgggtgacagaatgagactccgtctcaaaaacaaaaacaaaaaaaacccttaattttcttgttccctaacccctcaatcgccagtcaatggtcaagtccttacaatctttccttggcaatatcacctcagcatttgtatcctctttcctccattctcattgctgatgatgtgttcaggccctcgccctcattatatcttgcctaaaccattgtggaagtctccacatggtcattctgccactctactccatcttactctcttttccagattgcttttaatcatagttttgatcatgtcactatcttttgtaaaaccttctaccattgggaatgtaaaatggtatgatgctatggaaaaca

SEQ ID NO: 393689 - DNA, 410 bp, Homo sapiens
cttctttcctttctcatacagtttttttctcttgacttgtcatagtattggctacttgtcattctatgtgaagaaaaattaaaaattaaaattacagcatgaattcaatttaaaaattaaaaaactaagcagtgaagtttttagcatgaatttactcttcatctttttattatacaatgttgtttttgttgttgttgttgtttgttttgttttgttttgttttttgagacaggatctcactctgtcacccaagctacagcgaggtggtgtggtcacggctcattgcagcttctactttctgggctcaggtgatcctccccctcagcttcccaagtagctggaactacagatgcgtgcctggcaatttttttttgtagagacaggatctcaccatgttgctcaggctggtc

SEQ ID NO: 393690 - DNA, 417 bp, Homo sapiens
ctaaagacccttttcctccttttctggaaaacatctctgttaataaggatggcctgctttagtgtttgggatagttcccaagttgttacgcttggatttgatctgggttggtgttgagtatctgctctcactattctcctatatgccagtatatgtgtcccaatttttcctttaatgtcaggtgtccctttaatctaaatccagttttgtctgacagagctctcccatagtatccttgatactgatatacatccaggacttgttgaaaactgttacaaatcaagctgtgtatcttcagacttgtcaaatctatcccatgattaaataattctgcttgtgagatctgcttggactctgtatgattttcctgatcttgataccctgtgaggaactcattagttacttaagtggtattac

SEQ ID NO: 393691 - DNA, 452 bp, Homo sapiens
aactgttccctctgagatcaccaacattctttaatgctatatcctatgtaaataccttggtccttgacttatctgatctcaaacagaatctatacaaataaccattcctctcagtcaccaagtgcagcccatactcaagggggtggtaggaggtggggggttaagttccacttccttgaggaggggagtgtctgcacaaattatttggaattctgtacaagataaataagtggggacagttatttatttaaccatttattttaatcagtgtggacttagggatatttattttatgctttgggtcataatccaataatgcaatattatttattttattgctcaaattgttccagcttcagtcactgggtgctctttcagttggctcctgtatccctttaccaaccccctgtccttttgcattttgcatattttcttattttctggcactctac

SEQ ID NO: 393692 - DNA, 320 bp, Homo sapiens
ctttacctccctctcattgctacaaagactagattgattttgtggtcccttcccactccaaaattacatgatgccatagagacatgttaaagaagaatctttatcataaaatcattagcttacggctggcacatttaacaagcatggtgctctcatgcaattcctgtagcaaagacaacctctacaagcaaatgagccagccatttctacttgttctcctgaaaccatcctcaaaggtgggggactctcttaggaagtagcagctgagatagcacttgagatagacacagatttaggcaatacaattgtccatctgatta

SEQ ID NO: 393693 - DNA, 433 bp, Homo sapiens
gcacggtatatcacagacactcaagtgaatgccaagtgaatgactgaccgaatgaatgaatataaaaaactaagtaagtgtattttaaaaacagattttagatcaggcatggtggcttgtgcctacaatcacaatgacagagtcagactgtgtcttaaacaaaacaaaacagattttggcagagagaagcgatctcacaccaagggatggtgagaccctggagaagaggccaagccaaactaacagcatgtgactgtgctttttgagagtccctcagaccagtggcagctaccatggcacagctgtcgtacggtgttaaggctctggcttacccactgccaacagaaatgggagaagaaagaggcaggaaggaaatgggtagtgcagtagtgagtacacacagtgagaactggatctagatggaaaagcaatt

SEQ ID NO: 393694 - DNA, 474 bp, Homo sapiens
gcaattctcctgtctcagcctcctgagtacctgggattacaggtgcccgccaccacacctggctaatttttgtatttttttagtagaggtggagtttcaccatcttggccaggctggtttcgaactcctgacctcaggtgatccgcccgcctcggcctcctaaagtgtattcttttttgatttattcccagtctcttggctgaaacatggtagctcaccagcatttctactcccatttgtccaactgacggtatcttttcacatctctagagaccagaaggacttcctcttcttgaatttcctgttcagtattctttcttggcttggttccttggtgagttttgaggagatggtgcatgggtgtgtttttcggctttgttttagtatgactcagggttgccaccatgccttgtacggtctcctagtcatagtattaaagtttccgcttagcaggaaaccagaaacttcctttct

SEQ ID NO: 393695 - DNA, 440 bp, Homo sapiens
tatataattttcccatcataaatgtaagcatcatttcatgtttcatttaaaccccctttttaagaatcacaaagatcctaaggcgtttcatgtcagagacataaggcaggccccacactggggttttttttcggtgatccataacgtgatgctgaaataaaagtggcaaacaatttttaacactgcatatgctcaaagacctctgccaagaagggggaaaaatagtcttggcaccagaagttaaagtgcaacagtttctttgtgatcagtaatgaggaaacaagtggctgtgttctcgatcttgtcaaatcagcatgagagcagcatctgaaccactcaggaggctggacgtgcatttctacagtggattcctaattctgttttctggggtggagaaatatgttcagcttcttcagcagtttgtgaatcatgtgcctgaa

SEQ ID NO: 393696 - DNA, 483 bp, Homo sapiens
ggcaaggctggtcttttgctcttcagtggctttagttagtacttgcctaatacctgaaggtcacagggcatttgtaagcatgtaagagttttaatcatttgtactgtactttgataaagaagggttcagtgacttgccaggcttgcagaataggtttccaaatcctgaatataacagctagagaatctgatttataatatgttaattctccgacttgttttacttacaaattagtttgtaaaatgcctttctaaatgtatcttaaaggaagaattcagaattaggagctaaaactttattcaaagtcaccatgttgtaatcacaatattcacaaagcatatgtggttatttgtaccaaaaactctacctgattatccaaattggtgtagtgaacagttccaactccgctattttatagggcaatactctttgaaagtataaaccaaattcacatcttcaagttctagaatattaaaataagtg

SEQ ID NO: 393697 - DNA, 334 bp, Homo sapiens
aaacacaccagcccctaaaggctgcagtgcacctatccatcaacacccgccaagccagtctggcaggcatccgtcacccagcaagtggtcccagtaacttcccctgcaggccctaggtctgactcttaacctcacactatcatatgtacctagagacatgagcacaattcaactcaatcaatgtttattaagcaagctctttgtgctgaatgctgtattcttttcttttaattcttcagccatagtcctggtcacaccaaatgcagcttggtttagttccccaatcatcccagccattcgggtccctgcactgcagctccatccagtctctcta

SEQ ID NO: 393698 - DNA, 228 bp, Homo sapiens
agtttacagcaggagtcagaatgagctatcttctagaaagaaataagaatggaacagcattcaatagaacacccatgaacaccaaaggaatgagggaaatattgttgcattaacattttccagaaaagagccctttttggtacctaagggagaattacccaactactattttataaaatgaaattattttcttcaatagttagttgttttcaagatgggccccagtgt

SEQ ID NO: 393699 - DNA, 522 bp, Homo sapiens
atcagtgacaaatattgctgattggtcaaaaaatgatgggaactgagaatcaactattagagggcaagtattaaagctatgctatatactgaaggcttttttatatagaatgcaagactatttaggatggtcttgttagtggctgatagagattattggcataagtgttttagtcactctgtactcccaacctatcctttgacactgtcctaagattgtagagagaaaaagtactattgtaatatccccaaagagaacattctactctaatccaagaaaatctcctttatccgaaaggatttacatggaggaagtaaagagccccactcttaaaaaaaatatgacatgagtcttatttagaacagtagttttataatacttagaaaattatagtctatataaaagcacatgtatttacctcttgtccagaacttccatgtttcattcctgacacttttccttttgtactgaacttattccctaaatctaaagtactgttcattaaaatacaatgcaagccac

SEQ ID NO: 393700 - DNA, 169 bp, Homo sapiens
ttcaagcttctaacgatagtacggggacatggctaggataaagcaagtagaagtgctgggattacaggcgagagccaccgcacccggtcggaaatgctattctctattggcacttggaacaaatcatttacaagctcaaaatgtttccataatatattttagaaaagaa

SEQ ID NO: 393701 - DNA, 294 bp, Homo sapiens
ctaggaggcagaggttacagtgagccgagatgttgccactgtactccagcctgggtgacagagtgagactccatcaaaaagaagaagctggttgccaaggagatgtcagattgcaaaaagctgttctttgtgttacaactcagtaaggagccagcataaccatataaagagggaagttcatttattcattctacagttgtttactgagcttctgctaggtaccagacattggtctaggttcttggaatacatcagtgaacaaaacagatataaaaaacccctgctgtcatggag

SEQ ID NO: 393702 - DNA, 592 bp, Homo sapiens
tccaggtaaaaatccagcttcttcacaagtagtaaaaaggaggtaataatgtacatggcatcccaaattattcattttgtcacaccattcccctgcattcgtcaggatttcatttggctcctttttccaaccttagcccagcatgctagcaggtatttatcaatatattaaatgctacttaaacttcctaaaatgatcccagaacagtaaaggggaaaaaagcttctgatttaaagctaaacatacacagctatccattagcatgacaatgtctgcattttacttagacattgccattaataatgaaatgatgtatgatttccactccagcagctcttccttccttgcacaatcaattatacatttaagaaaatacttagtggatagaaagctcctctaattaagcatcacttgagggagcttgtgagattcttaaaactagaaaagatatctcagagaagtaggatggtggagggaaaaaaaatccactcaaaatgtttgagtcttgattagacaaactctcaggcattctgaaccactatgaaaggaaaaactcacacacacatatattttaacccaatagactttgagg

SEQ ID NO: 393703 - DNA, 509 bp, Homo sapiens
cgacgctgctagtgtccatatgcataagtagctgggtatttctgcaactagggaaatttaaaactcaagaaaattgctctgagcactaataacaaatctcttacagttgttcaaccctgcacagctcacaaagtgttttcatgtcccttattagaagcaaaggggtacagtcaaagggcaagaaccttgccacttaagaaattgtgaccctagtcaagtaatttaacatctatgggcctcaattttctcatctctatagtggaaacaatagtacctaccttgcaagttgaaatcatgcccataaagcttgcattctacagcatgtgtgcaataagacatagttggattatgcttattaattgtctttatattggggcgatactgacaaggaccaactctgtgggacatcaacattcactagatcctcctgattaactttcggcctcagaagaaggaacgtgggcaacattgtgatggtcccaagccagcaaatgtcaacatttccaaaa

SEQ ID NO: 393704 - DNA, 578 bp, Homo sapiens
cgggaggtggaggttgcagtgagccaagatcgtgccattgcattgcagcctgggcgacaacagcgaaactctgtctcaaaaaaaaaaaagtcaaccatgtgattagagggctggggctttgagccagcaacaccagcctgagctcctctgggaaggaaattgagttcaatcatgtggccaatgattccatcaatcacacctacataatttaaaaaccctaataaaaattttgaacaccaaaacttggctcaaattcctggtttgtaaacatactgatgcattgggagggtgagcccagaaagaagacatgaaagctctgtatcaggaccctcccatatctaatcctatggatctcctaattatgtcatctacaataaaactgtaatcattaagtatagcactttcctggactctgtgaggtgctctagcaaattactgaatgtaagagggtagtaggaatccttaaatttgtagccagttggtcagaaatgtgggtggcctggggaacccagaacctacaactgggcagttcagacagttcttgttggggactgtgatcttaacctgtggtgtctgtg

SEQ ID NO: 393705 - DNA, 562 bp, Homo sapiens
gtctacactaggaagcaaaatgattcagttgctaatttgaagttactgttagtgggtaagactcttaaggtgttataagagcagaaagcaggtgtatctaatccagttttttgtttttaaagtgtggggatgctttttcgaagaaacaagacctgagcagagctttaaaggatccaagagtgggatgggtggatgagcacttcaagtaaatgcgacggcatttaaaaaaaaaaaaaacaacaaaacaaaaacccagcattttaaaaaaacataagatggtctatagcatcctcaaaagttaagatttgtaaaagaacttcaatgtgattttctaaaaagccctacggaatgcaaatatgcacttgggcacatttcagaggtaaatgtccatccattttgacaagagcgccatgtaatctcagcactttggaaggcgacaggatggctggtagccaggagttcaagaccagcccagtcaacatagagaaaccctatctccttaaaaaaaaaaaaaaagagagagagagatttgaatccccttctccctcccaaatattagaac

SEQ ID NO: 393706 - DNA, 606 bp, Homo sapiens
ttgtgacaatgataagtgctacagacataaagggcacatggtgctaggagagtccatcacagggcaatctgacctagtcatgaaggtcagcaaaggctctccaagtgaccatagaactgagaactacagggtaagcaggattaagtagaagaattggggaggaaaaaatgttcaggaagagagggaagggcacgcacagggcaagataaagttgggaagtaggcctgaccatgcagtgctcttgggcatgctgaagattttgattttgattcttagaggttctaagcaaggagcaggtgacaggatcagatttgtatttttaagagattattttggctgtggttacagaagatggaagcgggggatgggatgagcaccttttcgctgactctgagaaggaggaggaagatattgaggacattgaagaaaatactagacctaaaagaagcagacctacatcgtttgcagatgagctggctgcccgcatcaagggggatgccgtgggtcgagtggacgaggagccgacaagtgagccccagccgcgttgatggggagtacggggggagtagtgcaggggcctctgctgggttcaccaaaggcggattt

SEQ ID NO: 393707 - DNA, 345 bp, Homo sapiens
aagcagttctcctgctcagcctcccgagtagctgggactacaggtgcatgtcacctagcctggctgatttttgtatttttagtagagatagggttgtgccttgttgcccaggctggtcttgaactcctgagctgaggcaatccacctgccttaggctccgaaagtggtaggattacaggtgtcagccacctcatctggcctcaaagatgcgttcttatagttggtctgtgtggattgggatcaaagcacacatattactattggtcattctcccttttaatctcctgttttgtaattataagcccctttccatttttttctcccacaccattgatttctgtagaa

SEQ ID NO: 393708 - DNA, 238 bp, Homo sapiens
actcctaacttcaaggaatccttcccatttggcctccaaaagggctgggattacaggggtgagatactgcacccggccttgttttttaaataacaactaattgcataataccataaatctattaagtagataaattgggagtaattatttacattacttatcataaaaggattcatctcagagctctgctaagtgttgtaatgccacttcttcattcctgcttctcagtctgtatgtg

SEQ ID NO: 393709 - DNA, 374 bp, Homo sapiens
atccattactgactagtccaacacatcatgagggttcaaaccagaggggagccacatccaagcactctgcagaatctcaaaaattcactctcccccatactctcacttttacctagagcctaatcactctatagccactattaaggctctcattgacataattatggcacaaaagccaagcccatcagcatgctaaataaattatgccattgagattttaaaacttgctcagatttttcagtctccttactaaaaatgttctttcttgaaacaaagagtttcttcttatcctttaaggataaggaaaagccagttactcaatacaaaatattatattgaaaattttgaataactttgaaagacaaataaataaa

SEQ ID NO: 393710 - DNA, 491 bp, Homo sapiens
ccaaataaaacccaagaaaaatgttcaagcaagactttcccaatggttacttctaagcaggctgctcatatgccactgccatcctttagcacattgccctaacttcattaaacacttttaggaatatatatgtgtgtatatatatgaaaagtctttatttaataaaaccttatactttaggcattatgttatatttccaagaactttagtcatttttcacattaaagtcttgaacttccctaattaaactgtgaatattaaaataactctgtgtaaatagcaaataactgggagtgagtgacattcagtggacattcataatcagttattgaccaccccttaaatacacacaccacaaatacaatctccacaatgttccctactctatcgttcaatacattttatgcatcgattattacatactaatgggctgtgtaatatcctttccagatttcattgtaggtattttattaaaatgaatagattcaatt

SEQ ID NO: 393711 - DNA, 457 bp, Homo sapiens
tttctgctacttgagcccatcttcccctctgcagttgcaatggaatttccaaatgatttatctgaaattcacagctgacatggtgctcctctgaggctcacagacggaaggaagcccacgacccttagcacagtactgggggctctttctagctgcatcccgcccccttgcacttctgccttgggcacgccctttgcttttcattccctccacacactgccatgctattgtgagactgaggttctgcacgctgtgtcccctgtgcctggaatgcccttccctcacttctgcgctcagtgaatccctgtccttctgcggccctcgcaggcagcccctcctcctgctctcgtgggatgctggcacacttgtgtcctattttccacgtgatattgaatacgtctattcacaggactacatgtaccccgagtcgagggaccaacccttctttacatcgcta

SEQ ID NO: 393712 - DNA, 195 bp, Homo sapiens
aagggagccctgctgaggaactagatcacttttctcgttcaagccgagcccaccctgcagctgccgccctgcccttccctctgccggccactgggcttgaactgccattgcactgggcctgagtttttcaggaaagaccggaaatctttgactaaaagagaaactcaggtggaaagctgtgtgtgtgtgcgtgtg

SEQ ID NO: 393713 - DNA, 431 bp, Homo sapiens
cttaaatacaacacaatttggattcttatccttatttttcacagctatgattacctgctgtatacaaggaatcgtaagaaaaatttaaaaagtcatatatctacctgacaggacatgaaagtaagaatttttcatcaacctaaattctaggccgggtgcagtggctcatacctgtgatcccagcactttgggaggccaaagtggggagatcacttgaggccaggagttcgagaccagcctagccaacatggtgaaatcccatctccactaaaaataaaaaaattagccgagcatggtggtgggcgcctgtagtcccagctactcaggaagctgaggcaggagaatggcatgaacctgggagatggagcttgcagtgagctgagatggcgccactgcactccagcctgggcgacagagcaagactccatcaa

SEQ ID NO: 393714 - DNA, 276 bp, Homo sapiens
atgatgtagtgaggacatgcactgtggcgtgggatgaagagggaccggggagacttgtctaggaggcaccagctgtaggtcacgtgagtcttggtttctgacctagctgatggtagtgccacttgttgagatggggactgagcaaagaggagtgaatgtggtaagcacaatttatttcagacatatgtttgaggtgcgtttggaacatccaggtggggatgtgtaaaggcagatggatagaatagctgagattagttgtctattgctgcatgacag

SEQ ID NO: 393715 - DNA, 369 bp, Homo sapiens
gcaggagtacagcacagaccaagaccacagtcttggtcccgaggagcctgtggagtcacagactgggaccaagactgcctcccacaccctccagtcaggggtggctctagctgatttcctgggcaggcacctatctgtcctgggcacaccctccctagctcagcagaagcaaggccttcctcgtcccagcaagtagctgggctgggggaacgtggcgcctgcccacacagtgtcccatgtcccactccaccgctcacccacccaggcccacaggcacctatgccagggcagggctggggccacgccacaccctggcagccctcacccggtggcctgacaatgccgcttcactcccaggcacaagtcgga

SEQ ID NO: 393716 - DNA, 520 bp, Homo sapiens
gtgcgcatctgtaattccagctactcaggagtctgaggcaggagaatttcttgaacccaggaggcagaggttgcagtcagctaaaatcatgtcactgcacgccagcctgggtgacagagtgagaccttgtctcaaaaaataaaagtaaaaaagggctgggcaggaggccgaggtgggtggatcacctgaggtcaggagtttgagaccagcctagtgaacatggcaaaacccgtctctactaaaaataccaaaattagctgggaaactttcagccacagaccacatgcagcaatatacaacatcaggaagtggctatgaaaactaactgcctgcgtaaagcctttcagcatctttccactcctaagctctccttagacggctctgcactgtctgtctcctacgcacctctccacttcatcccagccctctgtcctttgctgactacgcacctgcctcacgggcatcctctgttcgtgagcatgccaaaattgtctcccacctcacagctgagcacctgatg

SEQ ID NO: 393717 - DNA, 339 bp, Homo sapiens
ctaggatgccagattatccgtttcttttttgtcggattattttcaagtattttttttctcagaaaggatggacaggtggtacgttttctgactccttaaatgaccgaaaatgtctttcttttgcccttaagcttagttggcacttcagctgaacataatattttatgtccatgtatttttgccttggatttttgaaagcatagttctgttatctaaattgagcatacagtaatgctaccaaggagcccatcagtgtgattcttgtttcttcctagataacttgcttgaagcttgtaggattttctctttaggtgcactattgtaaaatctcaacatcat

SEQ ID NO: 393718 - DNA, 328 bp, Homo sapiens
accaaaccaggaacggcagatggatcttacaaacaggatattggttgagctaattggagcaattttaaattgaaatgattgcctttatttgtcttatctttaaactgaatctcaaacttttacctcagttttttacaaataaaatgcaagagggaagttgttttactgttaactgattatagattataatgcctttttcttcatgttcttatttcaatttttcacttttgaaaacgttggacccatttttttaagtgtaactccccaaagaagaaaaaaactctatactaaaatttagaaacctcctaataataactgtcccgttaat

SEQ ID NO: 393719 - DNA, 781 bp, Homo sapiens
atgatatgattacatcccaaaaacccattataaattgaaaatgttaaatcatgaatgcatttaatatacctaacatactgaacatcagcgcttagcctaggctaccttaaatgttctcagaacatttacattaacctacagttgggaaactcatctaacacaaagcctattttatactaaagttttgagtatctcatacaatttattgaacactgtactgaatgtgaaaaacagaattttgtaagggtacacaaagcataatttctactgaattcgtatcatgttcacaccatcataaagtcaaaaaatcctaagttgaagcatcataagtctgggaccatctatatattctatgttttttctgataacaccagtggctactaagtgactaatgggtgggcagtgcatacaccatggatatcctggacaaaggggtgatccacgtatcaggtgggatggagcgggacagcatgagatttcatcattctatcaaatggctctcaatttaaaaacgtatgaattatttctggacttttccacttaatattttccaaccatgattgaccatgggtaacttaaacttcagaaagcaaaaccacaaataaggggagactactgtactggaagttccatccaaggcaattaggcaagaaagaaacattaatccaaattgtgaaggaagaagttaaatcatatctcatcacagataacatgatcttacatgtagaaatctttaaatgggccaagtgtaacgcctcaccctgtaattcaagcactgtgg

SEQ ID NO: 393720 - DNA, 217 bp, Homo sapiens
cctttttcttcatcaaactaacttatggataacggggtttctctcgactcagtgatttgcagtgcatctttgtttcttacaacttggaagtcgcatcatttacgtaatgatcttgaggaagaaagaaaatgcaaagggaagtatgaaatagctataaatttgtttccttttagagtagacaaaaattcgtaaattctaaatgatctttgttattttt

SEQ ID NO: 393721 - DNA, 438 bp, Homo sapiens
cctttcttggcttcaccatgttaattcatcttttgttctttctcaaagatgtcaagcttcctgcctcccttttctctcctactgccacaatctccactttacgtgtatgaccacaaacttaaatgggccctcagcactatcaaaagactcattcgtaatctcaaatcaacccactctccaaaataactaattcactgcttcttctataatacctccaaactcatgctcagctcattcccttgtttcttacttcagtgagcaaatacaagctatcagaataaaacttcatcttcccactccaaaatctacccatatactttgctttcaatattgttaaaatgaatgcacactccctgctcctgttaaaggtcactctctccacttgtggactgcattccatgatttcccacttatttgaaattttgctcctagaattat

SEQ ID NO: 393722 - DNA, 138 bp, Homo sapiens
gcattggttgatgactccagctctcctttcctgaatcatgtcatctcctgagccctgaaatacccagaatggccaggttagagatcatgtaacaacacagcactgggccaagaggaggcccaagttcgatctcacttt

SEQ ID NO: 393723 - DNA, 287 bp, Homo sapiens
aaatgtctactgcaatgcatagcataggcactgaacaactggtaattctctctaagggatcaaaggtcattcactggggagatgcctctaggaatcattatttcctagtaaccatcttcattcacattctggaaagattgttgtctaggaagagaaggcatttttatttaaagaaattttttttctgaaggtatatcagcaaagaaggcatttttaagaaatagttattttagtgactggtttcttttccaaaggaaagttacatgatgcttatgataaatgtttag

SEQ ID NO: 393724 - DNA, 201 bp, Homo sapiens
tactgctccatgttatggacaagaaaactggggctcagagaggggaagtgaccagctcaaggccacccagcaggacagtgacagagcttggctcacatgggaacccaggtttcctggctgtagaggaaggagaagttactgacgtgtgtgagctccatgctccacagtttgcagggggcggtcacccatcttttccccagt

SEQ ID NO: 393725 - DNA, 412 bp, Homo sapiens
ttttcacaggtaacaggcacgggtctggtatggttagcaagctgccgtagttcacagccaggggcccagttctttttaggagagcacctttgcttgcaggtaactccactgtggagtttgcccgaggtgcagctgggcagtaagtgtggccccttcccttccacatctcggctgttccaacaccgagaagctgctttcgtttctccaccaagccccctctcccgggcacttgtccctcctggaccctgctgcctggggttgtcttgcccaccaggtaagacatgtcctagcacagaggaggagagagtacaggtgcccacgtggctagaggtggtgctggctccctcacgggcattcaggccaatgcccactggatgcagacatgagcgagtgagttctcctgtcctttccc

SEQ ID NO: 393726 - DNA, 402 bp, Homo sapiens
tcgctgtgctactccacaaacagtgcccccgtctagagtgtacactgttgtggagaattctgggagtcctcccgcctggagtggacactgttggggaggagtctaggggtgctcccgtctggagtggacactcactgaggagtctgagagtgctcccatctggagtggacactcactgaggagtctgagagtgctcccatctggagtggacacttggggaggagtctgggggtgctcccgtctggagtggacactgttgttgaggattctgggagtgttcccgtctggagtggacactcactgaggagtctgggagtgctcccgtctggagtggacactgttcttggattcgtagccacacctgatgtccttgggctcttacctgcttgcttcaccttctcc

SEQ ID NO: 393727 - DNA, 414 bp, Homo sapiens
agtgaccagggaattcaggtagatcgtgcttttctgtttgctaggttgagagaaatttgacactgggcaaatggaaatttgagaattaccccgtggtttcaattacccatctctgtatattcccatttataagagctggagatttgactgacaggtgtagttagtccaaaatttagaaaggggggcaagggactaaataaaaacttaaggcagccacctaaactgcaagagcaggcatttccgcagaagggatatttgtgtgtgagacttctaggagatgggcatgaggtttttaccaggccgacgcgtgtgtcaatatttcatcggtagtatttctcaggatccacgtctttacagtactcttttcctaattctgagggctgcttctgcccctgctgtattaacaaattcctc

SEQ ID NO: 393728 - DNA, 270 bp, Homo sapiens
ttctaactgccttagtttacaagagccaataaaattcttttttagttaagccagtttgagttgggcttctgacacttaaatagaaatatcccaaacttttacacagactaaatactgtccacgaatgtttgagaagatgcactgcactgaggataaagtattctcaaaatgacttaacagttaaaagtatgtattatttgaagacttagatcatttcttctgtaacatagctttccatccttccctctcctaattaaagagcacaaaaag

SEQ ID NO: 393729 - DNA, 2297 bp, Homo sapiens
cactttcactcccaaagacatcctttggtgatacttactgtgggattcagagtggggtgcagaggacgaccctgcaaaggcacggactataagagagatctgtgcagctgcgcctcagggggtgtcctgggcccctgggcatgacaggagggggaccacttgcagttctactggaaaatttaccacccttccagaatcctctgaagatatacaggtcgcaactagagtgagacccgagtactgccttgggtcagaatggctagagaaccgagaaaaaacgcagccctggacgcccagtctgcagaagaccagacggggctcctgaccgtgaaggtggagaaggaggaagcctccgccttgacggcggaggtgagagcaccctgcagccctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggttcccgttggtgaccaggggcaagaactgctctgttgcaagatggcactattgacacaaactcaagggtctcaaagtagccagtgccagccaatgaaggctctgttcaagcatgaatctctgggatcccagcccttacacgatagagttctccaggttcctgggcttgcccagggagggtgctgcagagaagatgcaatggtagcttccaggctcactccagggtcccagggtttgctgaaaatggaagatgtggccctgaccctcactcctgggtggacacagctggattcatctcaggtgaacctctacagagatgaaaagcaggagaaccatagcagcctggtctcccttggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatggtgataaaaatgttcagaatcctgagcacggggagtcctgggaaagtcagggtaggacggaaagccagtgggaaaatactgaggctcccgtgtcttataaatgtaatgagtgtgagagaagtttcacacggaatagaagtcttattgaacatcagaaaatccacactggtgagaaaccctatcagtgtgacacatgtggaaaaggtttcactcgaacttcataccttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagatgatgagttatcttctacattctagaaagtgattggaagaagtcatttgataagaggccatgggagagtggtctggaagttgtaggacctaaaatagtttgttctcacccagtgtatttaaatggccttctggacttgttaattgccctcagccagcactttaggacatctggttggatggctctgatgtggggggctgctgctctgaccattcattttgcctctaatgaatctttcacaaattggtcagatccatgag

SEQ ID NO: 393730 - DNA, 2293 bp, Homo sapiens
cactttcactcccaaagacatcctttggtgatacttactgtgggattcagagtggggtgcagaggacgaccctgcaaaggcacggactataagagagatctgtgcagctgcgcctcagggggtgtcctgggcccctgggcatgacaggagggggaccacttgcagttctactggaaaatttaccacccttccagaatcctctgaagatatacaggtcgcaactagagtgagacccgagtactgccttgggtcagaatggctagagaaccgagaaaaaacgcagccctggacgcccagtctgcagaagaccagacggggctcctgaccgtgaaggtggagaaggaggaagcctccgccttgacggcggaggtgagagcaccctgcagccctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtagaaagaacaggtttagtatctgagcgctgtggtctgtttcctcctgaaatcccagatcggagcgaggggcattcctttaaggtccaggagttcttcatctctttttgtactgtgaacctccttggcagtaagggtttgctgaaaatggaagatgtggccctgaccctcactcctgggtggacacagctggattcatctcaggtgaacctctacagagatgaaaagcaggagaaccatagcagcctggtctcccttggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatggtgataaaaatgttcagaatcctgagcacggggagtcctgggaaagtcagggtaggacggaaagccagtgggaaaatactgaggctcccgtgtcttataaatgtaatgagtgtgagagaagtttcacacggaatagaagtcttattgaacatcagaaaatccacactggtgagaaaccctatcagtgtgacacatgtggaaaaggtttcactcgaacttcataccttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagatgatgagttatcttctacattctagaaagtgattggaagaagtcatttgataagaggccatgggagagtggtctggaagttgtaggacctaaaatagtttgttctcacccagtgtatttaaatggccttctggacttgttaattgccctcagccagcactttaggacatctggttggatggctctgatgtggggggctgctgctctgaccattcattttgcctctaatgaatctttcacaaattggtcagatccatgaggtcttttactcttctttgtgccttgtatgataggtgctaataaacatttattaaatgtaccagtaaaatggcctttgtaccaaaaatttgat

SEQ ID NO: 393731 - DNA, 376 bp, Homo sapiens
tcaactccacagttggcagggggttgggaatctaacctcccaatagggcctcccctcctgtccagaatcttcttcttttcttcttctcatcctctctgtgggtatcaccacaattcatcactgtcaccaaagcctgggagtcctcccagactccaaatccctaccctctctagtcaccccaaagccccgggcttccctatccctgccccttctatgatcaccagtgtatcaagaggaaaagctggaaatgtacatcagtttcacttagtgccagccaatgaggggcactcgtgacagatgggaaggcagatgaggagaagcccttcctcctctggtgttggtggacatctgcatctgcagacatgaggccagcata

SEQ ID NO: 393732 - DNA, 421 bp, Homo sapiens
gtcagacagctcatcactgggcttgcatttcttccaatcaaccttgggaaagttcctaaacctctctgtacctcagtcttaccatgtgcaaagtgggagtgaggaccatacttctgttatagagctttttaaaagaggaaatgaggttggtaatccatatagaacatttcataaagacatcagcttctagaaagcccttggtaaatgttagccacggctgctatcatcatcttcatcatcatcattaccatcattagtagtaacagtaggagtatttaggatgaatagtggtaggatgaggaagatgttgagccagcagggaaagttgtgcatttttctagaagcatcgtactatgttggcattgcacataagtccatgaaaacctatttcttatggaccagaagcacactgtgaacacca

SEQ ID NO: 393733 - DNA, 186 bp, Homo sapiens
gatcataacaatatgtagcgctcaacggtgaagaaaggccgggcttcgggcgacgctcgttttatttaaagtccgaggtagatatttctgagcaataggaagctctcctttactcagtgatttggaaatcaggcttcttctactttatgtctctatcatccctcgtgccttgctgtgtgaatctca

SEQ ID NO: 393734 - DNA, 345 bp, Homo sapiens
caaggaggttatgtgaacccaggcagtctgattcacgggccccctctctgagctaaagatttctttcagaactacctgtgatactaaagcagtgacataccagggcacccttgggcggaaggaagcaccaaaggacagggaccatctagttgctcaaaagcagaagagcaacttgcattgagggtgagctggtatgaaaacacaatcacacattgctcaggacggtttcttctcctccctattcctacctcggccctggcctcagggcagaagttctgcatcagacctcaggaggaagcgtgcgggcccttaagacacaaactcccattctcagaagaaagttgg

SEQ ID NO: 393735 - DNA, 261 bp, Homo sapiens
cccctgggcaactgtgtatagtctatcacacactgttatgcagcaaggcactggactcctttagagaagtggatgaaaatgctcctggtggtgggattcctggctgagtgtctgtacacaggcacagaagagaaagcagaattcatgttatgtatagaagatgaaggtttgttcattgcccctctccatggtgtctgtccatggtgtctgtctggccatcctctgccacaactcccagtgaggcaggatctgatgtagaat

SEQ ID NO: 393736 - DNA, 504 bp, Homo sapiens
gtgtgatccaagggtggcctaaaggaaaataaaattacgtttcttaaaaacaaacaatgccctgtagtttaaactgttttttgccagtggatgctaggggtgtaggagcctgtatgcctttatttctagcttctttgcagctcggaaagccactcatgggcctatatgagcaagtgcaggcttccccttcctcaagccttccttccccacggcaccccaactttaacttaacagaaggaaaatccaatctaaataaataagtgatttaaatataatggggtaagtgctgtcatggtaataaaatatgggaagctcttcaggtcttactcagaaggggggtcagaagaggctggtgtagaccttcaccaggccagtgctggtggtgagtgttttaagcagaaggcatatcccagagacaggaaaggacctgaaagtagttcagaatggctggcacgtggaatatgtaggtggagagtcatgagaaaaaggatattttttacttga

SEQ ID NO: 393737 - DNA, 464 bp, Homo sapiens
gggccaagttccctcatttttagaaataatattactctcatctactgcattttattgatttttatttgtttgtttgtttttgcttaaaaccagctatgtggtctgtcaggaaatgccattagaaattaaaatgtggtatttctttgataaaacacactgatttctatagcaaactattaccttaacttgatttttagtgtatttgagatttcaaaaggtcatcccctttaagttttttaacctaccattaagaagctaattaattgtaactttgaatattgctgtttgcaggtatagtgtgaggaactcataaattgtgccatttataagaattatacacttggaggtggaactaaatttggtgaatatcaaggtttattttggtaactttactaataaatgcataaagacagatcagataaagctacataaatacttttttactcttcctgtactagtttgca

SEQ ID NO: 393738 - DNA, 480 bp, Homo sapiens
gcacagttaggtgcccagtgcaaggggagggaggcccaggggctgcttcctgtctgcttctgctcagaccccttccacgggtgtctccagggggcagtcctcagccgggctctgactgaggctgggggagattcgaggctgtggagaggtaggaaccagtcctctgggtatgtccatttctggaggtggcacagagcccaggcccctccacagccaggtaatctgtttccacctccttggggtcctctttcatagagtcttgccaagcttgtactttgcacctgcacagagctaatagagacagagatgcatgaggactggctggtatccgaaggggctcccttcctagttgcagggtacagggacagctctagaaagctctgcctgtgggtagatatgagacatgtggtatgtgctggagcacaggcctgccaggcaggtgagggggtgcttcatgcagataagagtcacccctggctc

SEQ ID NO: 393739 - DNA, 547 bp, Homo sapiens
ataaaaacattctgcaggactctttcaggagtccaatacaagaatcctgttgtttgaatcagttagaaaatctgggctctaacagtccaagatttccttcttcaaataactgtggtcaaagcccttcatgtaccttgacctcagctttctcatctacagtaaggctaccaccctctgccatacctaatttgcataattgtcctaaggctcaaattgcataatgcttaaaaataccatgtaattacaccaggttacaagaaggtaaagtagcagctgtattttttatcattatcatagaaaatgacaaccacttatttcagctttattctattccttgatgatgatctacattctgcaaaattaaaattactaaatgtgttacaccacttaaaaaacagagctataactgaagctgtatcactaaagcaatatagtaaatgttcagtaaatgctgtttggattaatgaatcagtgtttacttctatgcccagcactatgttaacataacagaagttggaaaataaatgatgtgttccctaaaaaaaaa

SEQ ID NO: 393740 - DNA, 515 bp, Homo sapiens
ctctctgtcccctgcaacaaatatagcctagctaatacttacctctttcccccatctccctgatcactccttagttatcattgcaccccatgaggcttgtccaatgctttgtacatattaggcacacaataaatgtttgctaaagtgagttgatctgaatggtattcagagtcttattctagatagaaatggggtcttaaaagagaaaggccttggccgtgtccttgaaaagcccacaaaaagtcactgcacaaagatgtaaaaggcaaacctaactgttgacaacaaaattctgtcaccagttctcttctcctccacgaagtgggttttaagagcaacatagagagttttcatcacgtccttaaatgtggttttgctttacttcccaagccctagaaaacactctcatctcctgggcctcttctgttttcaagtccagactgaaaaaaaaaaaaaaagagcatgtagaaaaatcctataattaccagatctgattttcatttgaacttttcctc

SEQ ID NO: 393741 - DNA, 314 bp, Homo sapiens
cgacagagccagactccatctcaaaaaaaaacaaaaacccaaaaacaacaacaacaacaaaaaaacactttagatgccaattctttaaatagattaagggttaaaatattaagaatccatattcttaatatgttttaaatgtctatttacctattgaaaaggcagtaccattaaaggctctgagaagggtttgtaaaactttattgtgagtgatgctatcggtcatcaaactaataatagagattagacgttcttgttctgggatgttaaaaataacttaatctttccagattcttacaaatgtaaaagctatt

SEQ ID NO: 393742 - DNA, 343 bp, Homo sapiens
cgaattcttcaatattgaattttttaaatgaaacatttgtttcagctggtaaacagtgtacatgtttaatgccatttcttacggtttgtacaaacaattttggagatttggttcgtttcttgtcaacttcagagtttttcgatttttcagcttctgggacattagcactaaaatctcctttcacgtgatcagttaactgtgatttcttgttttgtgtccacttctccacctcgatgcctgtcatgctgtcttcatttttagttacattttcaacagtatgtgggttcaattccaatttttgttcttccccatgaccacatctactgtagtccatggattctga

SEQ ID NO: 393743 - DNA, 349 bp, Homo sapiens
cattccctcttgagaaaaataattacctcttgaagccacttgctatgtggactctagactaactgacaccaagctgccataaaataccataaaccctatagttcaacaaggtatagccaatcacgaaccaatgttccttctgcaaatcaatgataattcctgacgaacaattttataaccacctcctttcttaattagcttggtttaatttttttttttctgtcgagacaaggttttgctctgccgcctaagctggggtacagtggtgcaatcacagctcgctgcagcctcaacctcctggacacaagcaatcctcccacctcagcctcccgagtagttgggactacaa

SEQ ID NO: 393744 - DNA, 363 bp, Homo sapiens
aggagagacagggtttcaccatattggccaggctattctcaaactcctgacctcaggtgatccgccctcttgggcctcccaaaatgctgggattacagacaggagccaccatacctggcctggcactttctataaatgccacacaacatgttctgtgcagccgcgtctcccaccgttgtgtcagcggataagttgccgtgttccgagacaccaacctcacatggccgcacggaaagggagcacccatttgcggcttgtgcctgctgagtgcctgcctgggtcaggtcctgggagagctgggcctggcccggcctggtggcaccaagcagcactcgagataagagtgggggaacagtgacggat

SEQ ID NO: 393745 - DNA, 294 bp, Homo sapiens
ttagctgggcatggtggtgcacgcccagctattcaggagggtgagctgggaggatcccccaaacccaggaggcaaaggctgcagtgagctgagatcccgaccctacactccagcctgggggaccgggcaagactctgtttgtttttttaaaaaaaaaaaaaaaaaaaaaaaaaagaatggaataggtagatgaataatatgcttcatccatataacagaatacttgaggcattattcgaagaatatgtaatgcctcaggaaatacttagaatgtgctattaaataaagaatgca

SEQ ID NO: 393746 - DNA, 428 bp, Homo sapiens
ctttcttctccttctccttttttcttgagatagggtctagctctgtcacccaggatggggtacagtgccacaatcatagctcactacagcctcaacctcccagtctcaagcagtctgcctgcttccgccccccaagagctgagaccacaggtgcccaccaccatgcctggctaattttttaatttttttgtagcgacagcggtctcactatgttgctcaggctggtctcaaactcctaggctaaagcgatcctcctgcctctgcctcccaaagtcctgggattacaggcgtgagccaccacacccggcctgcagtacttcttgttccccatctcttgctacatttgagggccaccctggcagccccaggtgcccacacttttctgaacatggcaaatcgtggcagcaccaattgtagagctcaactgt

SEQ ID NO: 393747 - DNA, 117 bp, Homo sapiens
cccccaccctaccacacattcgaagaacccgtatacataaaatctagacaaaaaaggaaggaatcgaaccccccaaagctggtttcaagccaaccccatggcctccatgactttttc

SEQ ID NO: 393748 - DNA, 457 bp, Homo sapiens
cacatgctatttccattccttcatctctttcacttgtccatccattccactttttcttctacttgcaacatacaaccaaaactactcttatcaaggatgaacgccgcaaatataacaggcatatttcttcactcatcttgctccagtgtttaggggtaaacctggatattggaaattaaagctcctttatccctatttctaatcacactggattagaaatttgagaaaacaaatgttctctcttaataataggtctacagaaaccatcaatagctaaagaaagacaaagaatgcctcaagtggaccagcagtcagtgtatcatcagttttgaaaatacttcatgtgcattgaggaaatcagtttcaaaatatcctataactaataaatgaaccatatttaaacctaacaaaacaatgcaagggcagttaagtaagggaagtcaatgaccaaaattga

SEQ ID NO: 393749 - DNA, 164 bp, Homo sapiens
taatttattccaaaagatggcagagagccaggtatgatggcttatgcttgtagtctcagctactctgaaggctgtggcagggggattgcttgagccaaagaatttgaaacaagcctgagcaatatggcaagaccccatctcaaaaaaaaaaaaaaaaaaaaagg

SEQ ID NO: 393750 - DNA, 508 bp, Homo sapiens
ggtagaattccagctttttcctgtgcaagaccaatatctgaagcttgtgccttttgctgctttttccttcaaataacaggatcttatgaattagtgctttcattatatttgtgtctattaagtcagactacagttttcaaggtgcttttctattctagggagatctgcagggcacttaacctacattagacctaagaggtctgagggttcttcagaagacaaagaatttctagatactttccttgaggaggtgtcaagggcaatacagacaaaagactgatgtctcctttaacagcttgataagtatctcaggatattctgcaggaatcagttctgtttctacaaagtcctgtattcccattcagcatgatatggctgaatatgtgtgtgctacgtgtgacaatggtgaagacttatctttgccctgagggctgagtgctataacactgctcaagcgataggcttgatagaagtgatgatttggagagatgatctgctttaaaaaaaa

SEQ ID NO: 393751 - DNA, 386 bp, Homo sapiens
atacaaaaattagttgagtgtggtggcaggaacctataatcccagctacctggaaggctgaggcaggaaaatcacctgaaccttggaggtggaggttgcagtgaaccgagatcacaccacaccacagccctccagcctgggtgacagagctagactctgtctgaaaaataaagaaatatagccttcaggaaaacaatgatattaataacattggtacccaattagtaaacttaattgatcctcctacgagtctctgaggctgtctccatcttaacaattggagaaacaggttcagtgatgtcacatcaacagcccaatcctcacagacgttgaatggcagggccaggaatctaagcttggctccatctctctccaaaacgtgctct

SEQ ID NO: 393752 - DNA, 787 bp, Homo sapiens
gctcagctgtacaatgttgtataccactagttcttctcatagctgatctgctttaactcaaaagcatcaattggtactaaaattttcacagtatattggcagatggtgaaaatgctcaactacctcttgtcaatagcagcagcaattttgaagaatagcacgttaattctggttctggtgctacctatttgaattagcatgaacaaacattcctagcttcagtttcccatgtgcaaaataacattacatctgcctgccacctcatggattgtagtaactatgaaagaagtggaagtatacaataatacccaaacaaaaggcacacatcctcatacacaggttgcacaggatttttcacaaaggatgtaacatgacaatggacattacttggaagaaacttattttgtttgcataggcaaatttgttcattacatcagtaaataatcagtattttccaaacatggcaaatgttatctatcagactacttctaatttctttgtcttgtcctataacataaatatggaagagtctggtatgttcattttcatctccatcacttcaaaactatggaagactttcaataattaattccaaatgaataaatgagcatctttgagtgcactgtgaaaggtactggaggaggacaaattctgtaaaaggttactataccttctttaaggaaagatgagggaaggggacatacaaagttgacttaggatgctatgtagttgaacaagtaagaaggaggaaatagttgtttcagaaacttctattccttttgtcaca

SEQ ID NO: 393753 - DNA, 227 bp, Homo sapiens
ttcctgctcccactgcaacaggggaaaactttagggtatcctgtctatgatgaagttagaagaagaaacaaaagagatgcagccataaaaaatatataaaaaataggagattgggaagacatagggaagtcccctgaaagaataattcaacactatgggccagctacctgggcacaagatgggtcacggggatactgcactcctatttacatgcttaaccacatcat

SEQ ID NO: 393754 - DNA, 757 bp, Homo sapiens
cagtagaaacaccttcagtagacactgtatgttgtattttgaattttggtctttcccaggctcctgatacatggtatgatgctctcttgtgatgttgggcagtggcagtgagccatagttcccattcagtatactgtgttgccaagtggttttccccgactgtaggctaatctaactgatctgagcatgtttaaggtaggctaggtaagctatgatgttcagtaggttaggtgcatgaaatgttcgtttgagactaggtcttgctctgtcacctacactggagtacagtggtacaatcatggctcactgcagtcttgactttcctgggcttatgcagtcttctcacctgagccacagagtagctggaactacaggcagtgccaccatgcctggctaatttttaaatttttatttttagtagagataaggtcttgctatgttggccaggctgataaatttatctttgatttatattttcaacttacaatgggttgattgggactttattatatgtcggggaacatctgtgtagaacaattttaggattagtgaaatttaaaaatgggttcttcagaatactcccagaattggcagtaatttctgttttttttccttagaatcttttcatgaagcaatttctataaaacttctaatttcaaggtttaacaactttttcctggatttaatcttggctgcagtacaggaaatgatttaataaattaactcatttaaaacatttattgatttaagattatag

SEQ ID NO: 393755 - DNA, 380 bp, Homo sapiens
gccaccgcgcccggcctctgttaggttcttgagatccacccgtgagcaaaactgacaacagtcctgcccccacggagagtatcttccagtggagtgtgacagacaagaaacaacttgtaagatgaatgcacagtgtgttcgagtgatgatgccatggggaaaatggaccaggatgaggagactggagagtgaggggctgggcggtggcagcagtggggggcagctgtcactttacacagaatggccaggaagacctcctggaggaggtggcctttgagtccagaattcaggttgatgatgagggcgtgaggcttgggctgagagaagagtgagcagggagctgtgaatggtccaggcagggaagggagctgaagtgattc

SEQ ID NO: 393756 - DNA, 522 bp, Homo sapiens
tcttcctatgcagcaagtactatcctaagggctttacatttatttatggcacacttactttgaaaaaccctgtgaggtaggaactactattatctctagtttataaatgagaaaatagagtcagagaggttaagtagtttgcccagagacacacagcaaggaagttaaaactgtctattgccattgtgtagatctgagcacaaatgctttgtcatcaatggttaattcagtacttttttgactttaataaagctgagaatcacctggggatcttttagaaacatagcctgtggtgcagtaggtctggagtggggcccttaaaatgtatttctaacaacttcccaagtgacactgatgcttctggtctgaggatcgtatttagagaaggaatatcatcaaccatgtcctcgtcaaattcatagttctgggctgcatcatggtacacgggccatgttattagttgtctcccacttgtgtaagatgtagaggaaataacataagatgcctgtgaggatttgatgt

SEQ ID NO: 393757 - DNA, 685 bp, Homo sapiens
ctgattttcactcttccttggctcagaggatattgtttgaggtatacatttggaactaggaggtgaacaagtgctggtagttggttcacatttaggcatttaggacccatgataattcagggcattgcagaatagtcagggtagattatggagtgagacaggtctgatgtcattcaggaaggctggagtgtcctggatgacgcggctcataagtaaatgcctacttgtgagatcaactgtcccagtttgcctgagattgagggacttcccagaaagtgggtttttcattgctaaacccagggagatcttgagcaaactgggacaagttggtcagcatgtgtgggatgtaaaaatccatggtgtcagcttgagaggacaggttatggggtaacagtgggagtagggtgaacatggagcagctgccattgatggaactgaggggtactcttaagttcaggctttggagattagggtaaagtcacttattgcaaggcctaggcatggtgccttgtgcctgtattactagcactttgggaggccaaggtgggatgatttcttgaggccaggagatcaaaaccagcctaggcagcagaccccgtctccacaaaaaattagccaggcacggtagcgcactcctgtagtcccagctactcaggaggctgaggcaggaggattgcttaagccc

SEQ ID NO: 393758 - DNA, 396 bp, Homo sapiens
agaagtgcagtagtagggtgggagtgacccaattttccaggtgccatctgtcatccctttccttggctaggaaagggaattccctgaccccttgtgcttccccggtgaggcgatgcctcgccctgcttcagctcactcccggtgcaccgctcccactgtcctgcacccactgtccgaaaatccccagtgagatgaacctggtacctcagttggaaatgcagaaatcatccgtcttctgcgtcgctcatgctgagagctgtagactggagctgttcctattcggccatcttggaactgcccctgactttcattctttgtactatttttgtcatagatttttcttctatgtattttaaacactctataataccttgttactatttttgctttaaacta

SEQ ID NO: 393759 - DNA, 793 bp, Homo sapiens
gagaggttgggcaccaggactctttcatggtgcagctgctttttctccctgtgaaagagatgggaatcctagcatctcaacttgttcttttcttacaataggaaaagtgttcatacactgattcatctctaaaacattgatcagaaaatcaggataatcaggccgggcatggtggcttatgcctgtaattccagcactttgggaggctgaggtgggtggatcacgaggtcaggagttcgagacaagcctggccaatatggtgaaacctcgtctctactaaaaatacaaaaattagccaggcgtggtggtgcgtgcctgtaatcccaactactagggaggctgaggcaggagaatcgcttgaacccaggaggcaggggttgcagtgagccgacatcgtgccactgcactacagcctaggcaacagagtgagagtctgtctcaaaaaaaaaaaaaagaaagaaagaaaatcaggataatcaaatcacatgtcttagcccaagtgagaggagttttaaagagttgatcaaggctgggtgcggtggcttatgcctgtaatcccagcatgttgggagaaaccaccatcagagtgaacaggcaaccgaggcaggcagatcacctgaggtcgggagtttgagaccagcctggccaacatggagaaaccacgtctctactaaaaatacaaaattagccaggcgtggtggtgcatgtctataatcccatctactcgggaggctgaggcaggagaataacttgaatccaggaggcggaggttgcagtgagctgagatggtacc

SEQ ID NO: 393760 - DNA, 365 bp, Homo sapiens
tcactgcaacctctgcctcctgggttcaagcgattctcctgcttcagcctcctgagtagctgggattacaggcatgcaccaccacacccggctaattttttttttttgtagttttggtagagacggagtttcgccatgttggccaggctggtcccaaactcctcacctcaggtgatccacccacctcggcctcccaaagtgctggtattacaggcatgagccaccgtgcctggccaagttccggggtccctttttttataagggcactaatcccattcatgagggcagggccctgatcacctctcagggccccacttctctaatgccatcaccttggggttagaacatcaacatagaaatttggg

SEQ ID NO: 393761 - DNA, 398 bp, Homo sapiens
aaagtgtttgtaaatcaaagatctgataaaggatatgtacagactatttaaaaaattcccacaactcaatataagaaaactcaataaaatgtaaaatatattactggtttgaataggcttttcatcgtagaagacagatgaatggctaataagcacttgaaaagatgctcaaatcattagtcaatagggaaacataaattacaataccgtgaaataacactatacatccactacaatggttattgtccaaaagactgacaacacaggtgttggtgaggatgtgaagaaactgtaacctcaaatgttgctggtgggaagataaaatggcacagccactttggaaaacagtttggcagtttcctataaagttgaacacacacttaccatataacttagta

SEQ ID NO: 393762 - DNA, 278 bp, Homo sapiens
cggggcagggggattacataagatttacccatttctctccctatcatgcaatagttacccttggatcttactgtgctccctgatatatgtgaaggttgaaaatgggccagatgggaattttaaaggcaatgaggggctttaattgttttttcaaaatagtgtatgtacagtagttcaaaaagtcagatatgtaaccacaaagcttatactaaaagagctaaatcctatctgtggtgtataaaaccaatagataatatcttctaaaactcaagaagtag

SEQ ID NO: 393763 - DNA, 676 bp, Homo sapiens
ttatgacttcatcctggtaaagaggtcatttacttttggattatgattctactagtcttgcaaaatttacttcctaacctatatctttatgtagtcatgtcatacttgctcagaacttttcagactcccagtttgtgctttcagatgtttacttcctaatgctttcctgtatatgtgccttccttcagctagactactttttggctaatgtatttttctagctggctcattaattttatctacagtggcctctatcctcctgtgtgcctgctgaaatcctgtgcagacatctgatgtgtctccaacaggaggtggtctttacctcaattcaggcattatctacatgtctgcttgtctgacgtcttggaaggaactgggttgcttagatttgttgaatgactatatatgaagtcatcaaatggatttgttatttgttagtgaacagctagctataatagagtgctaaaagaggtagggaaattaactttcaaaatgggtataggtagttgaggtttcaaatgcagtgagcatttttgcattattttcctttaataatctttatgcaaatgcatgtagtaatcacatctccacattgattgaataattttagagacctggattactgtgacatagtctgtagtgggctataattattagatattcagagagttgcagc

SEQ ID NO: 393764 - DNA, 235 bp, Homo sapiens
gttgataccctggggcggtctagtggcaagcaggtttcgaggtgagggatcagcagaggagaggaagagggacaaccccacaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttctgggagagtga

SEQ ID NO: 393765 - DNA, 252 bp, Homo sapiens
ctcctggttcccctattgctgagaccttagaggggacccttggaatagtgccagctgtccctgtagatggatttcctgtgacaagcctagtggcagcacctgttgatgttgagggcagttctgtttgtgaccaagttgtgtggcctttgctggagaatgaggaaggccatgttgttgtttcaagtagagtaaatatttcttgagacacacctggagagaatgagctcctctcatgaggccgtcctgtggtct

SEQ ID NO: 393766 - DNA, 446 bp, Homo sapiens
gacttttcagctatgtgaatcactaaattccttttattttaaaaaattcattagaataagttttccattactggcaattgaaagcttcttgatacacttaagaacagctgaaatgaaaaaagcaaaatgttcgtaattctaaaacaatacattgggaaggcaaacaactgaaaaattattcaacaggagaatgtagtaaggtggcttattataaaatggatttatcaaaatccaatatgaaaacaacattttatgtgcagtaggcacaatccaatggccaactcaaaatatactcccaattcccttctcccactgcctccactagagggactgagaaagctgaatgctctctattccacaatttctcctaactaggagtgccatgtaatacggatctggccaatgagacaggaacagaagtctgctttgagcttctgggaaagttt

SEQ ID NO: 393767 - DNA, 750 bp, Homo sapiens
atccaaaacaccatttgaatgttgcataatattgtattttttttttgtcagggttataaacaatttctctctgatctgctgtcacacagaagggtatatccagactggtccctgagcctgggtaatttgggtttactccaggtgggtaaatgccttcttggtgctcagatctggcaggcaccaggagaggagacacacaacctgtgcaaagagcagatgttcaaagatgcttgttttaactcgtattttaagttcaggggtccccgtggaggtttgttgcatgggtaaactcgtgtcacagaggtttgctgtacagattacttcatcacccaatggttatcttttctgctcctctccctcctcccaccctccaccctcaagtagaccccagtgactgctgttcctctctttgcgccctaaatgagttcttatcatttagctcccactcataagcatgcggtatttggttttttgttcctgcattagtttgctaaagataatggccttcagctccattgatgttcctgcaaaagacatgaccttgttcttttctatggctgcatagtattccatggtgtgtatgtaccaccttttctctatccagtgagctaaaagtagaactgtcattcgacccagcagtcccattactgggtatatacccagaggaacgtagatcattctaccataaagacatgtgtattcggatgtttattgcagcactgttcacaacagcaaagacatggaatcaac

SEQ ID NO: 393768 - DNA, 264 bp, Homo sapiens
ccatagtaaagttaaaaaattgtaagtcaaaccatcataaattggggactatctgtattctatcagataggtagtattttgagcttaagcaaacatggtgtagattgttttaagaaattctgtgttattctcaagggaaatctatcagaaataagcaatctaattttggatttgtttggggcaatagaatttgttgaaaataccaaatgcaatgattaaattagttctagatgaaaaggcagatattgctgaaaagtttaatgt

SEQ ID NO: 393769 - DNA, 361 bp, Homo sapiens
tctaacacccctgccccaggcggctgctcagaaccgcactgaggactggtccacagaaacccgattctgtctcaggtctgtagtcctggaagcaggggctggacatgtctgtccttcatttctatacagtcagaccctgattgctggtcccatcctgtgtccacaaaccagctcacgtgctatgggttcacctgcagccatcggccagcgtcatggcagggagccggtggccatggctgaggtcacagttgggactgagaggagatttgagctccagacttgattccacctcgtcagacttctatggccttgggctagctccttcgccccatcccaaactgagcctcactttccccatctg

SEQ ID NO: 393770 - DNA, 456 bp, Homo sapiens
gacataggcttttggggttctgacttggccctggctaggattccttcattcggaagctgagccaggaaaactcaattataattcttcccacaaagagcgactctcttggccattcctccttctggggacctctgtcgtgcctctgccaatgggctgggtccctctcccccatcagcccacgcgccaggcagccacagcccttgtgtctgcattgcatccctgcgttgctctttcccccactcactggtcacctcttctgcattcagggggcttctgtttccccgttagggaccccagggctttagttctctgtccccagggagatgatgactctaaattctttcccttgggataatttccttttgggaacacatatgaaaggctgtctctcccctcaccactcacccctattgctaccccaattttggtttagtgttgagccatcctgtttcgaag

SEQ ID NO: 393771 - DNA, 279 bp, Homo sapiens
tgtaccatactctattgtgttttgcacacactccttaatttattcttaccttagtctgtaacaaagtaccatagaccggtggctgaaaccacaaacatttattgctcacagttctggaggctggaagtctgagaagagggtaccagcatggtcaggttctgatgagggcccttttccaggttggagactgtcaccatcttgctgtgtcctctcacggaggacatgtgtgtgcttggaggctctttggcagagctctaggaggtgtgtgtgcttggaggc

SEQ ID NO: 393772 - DNA, 354 bp, Homo sapiens
aaatgtggaaagccgggtccagtgttgccagatgttcagaatcttcaagagataaatatgtattaaagattttatttaggccaggtgcagtggttcacgcctgtaattccgacactttgggaggccgaggtgggcggatcacctgaggttaggagttcgagagcagcctggccaacctggtgaaacgctgtctctactaaagataccaaaattagccgggtgtggtggtgggcgcctgtattcccagctgctcaggaggctgaggcaggggaatcacttgaacccaggaggcagaggttgcagtgaactgagattgcaccattgcactccagcctgggcaacagagcgagactc

SEQ ID NO: 393773 - DNA, 402 bp, Homo sapiens
ccaacatggtgaaaccccatctttactaaaaatacaaaaaattagctgggtgtggtggtgggcacctgtaatcccagctactcagaagcctgaggcaggagaattgcttgaacccaggaggtggaggttgcggtgagctaagatcatgccattgcactccagcctgggcaacaagagtgaaactccatctcaaaaataaaataaaataaaattatgtttcatcttaagcctgcattctctcagatgattttcaaaaatgtttaaagcagcagaatcatacctttcaaacaaaatcttattgaaaactcaaatgtataaaatgtataaaacagataacatggagagttctgcctgctcacttttcttttctcattgacttggagtggaaaataatggatctaa

SEQ ID NO: 393774 - DNA, 168 bp, Homo sapiens
tcgagctccggtacccgacatgcacagaggaggtggacagcctgtggaggggtgtgactccctgggatgcagctctgtgccctgactccagtgtgccatgcttggctgatctctcaatgattaactgtgtgaccttggacacaccgtgttgcctcctctgcgcctgtc

SEQ ID NO: 393775 - DNA, 192 bp, Homo sapiens
tgtcacctgggcctttcctccaggagcctccaaggaaggtggaggtgtgacatcagagtgttgggatgtggaggggtgtgactccctgggatgcagctctgtgccctgactccagtgtgccatgcttggctgatctctcaatgattaactgtgtgaccttggacacaccgtgttgcctcctctgcgcctgtc

SEQ ID NO: 393776 - DNA, 362 bp, Homo sapiens
cccagtgtagacatcaccatttctggatcacagtggtgattactttatacatgctatctctgtgtagagaaattagtagctttccttatggtttaacaaaaagctctaggctgagtcacgttttcagaacttccaggcagccaggaactagaacaaacaggtgtccaagatgaagataatgtctgtgacagtaattttagcagactgtatcattcaaatatattatgaaggtatgggacaatgtgcatgtgtgtgcatgtgtatgttttggggatggtgagctgaagcaagaagaaggaaaatatattccagaaagaggataaacactgaaagtcccaaaaaggaacagtaacttcaatctg

SEQ ID NO: 393777 - DNA, 266 bp, Homo sapiens
ggattgcaggcacctggcaccatgcctggctaattttttttatttttagtagggacagggtttcaccatgttggccaggctggtcttgaactcctgacctcaggtgatgcaccagccttggcctcccaaagtgctgggattacaggtgtgagccaccgcacctggcctgaatggcgttttcattactttagggtatacttaatcactttttcctgctttattttcctatgctttttctgttgcctttctcagaaaagcattactgt

SEQ ID NO: 393778 - DNA, 413 bp, Homo sapiens
tttctccaggaccaaatcaactgccaatttggatatcatcgaggcacctgaaaccttatcatgagcctgatgctgaggaatagattctgggaggatcccgaggatcccctggttgcagccatgttgagactgacgctgagggggaccccaactgtcacgagcaacacccatcgaacgcagccacctacctggggacagatcaagaagctgtcacagatggcagaagaaaacctaagattggagaggatgaaggccctgaggtccaagaacatggaaacctgacagtggacgccaacagctgtggagagaagccgggcgacagctgtggagagaagccgggcgatatgctcacgcttccgtgtgcccagcaatcctgctttatctttttaaataaaggtgattcctgataacac

SEQ ID NO: 393779 - DNA, 200 bp, Homo sapiens
agaccatcagggttgtcggttaaaggaccaaagtccggacaggaggaagaggttttgacatctagcgcacagcagggtgaccagagtcaatgagagtgtgttgcattttgcaaaacaactgagagagtccgtatcaaatgtctctctgcatttagattggagaggatgaaggccctgaggtccaagaacatggaaacctg

SEQ ID NO: 393780 - DNA, 199 bp, Homo sapiens
atgtctaaccaaagtttcatagttttctccaactataaaaacaaaatatgcacataaaacatttcacgtgagtctttctccctccccagatcccagtctggccctcaggtaatcccctcagttaagtaacttccagacgatattcatgcatatactttttttttttttttgagatggacagtctcactctgttgcccag

SEQ ID NO: 393781 - DNA, 172 bp, Homo sapiens
acaaaccctcctgagaggacaccgcccaggccttggcatccccggacatcactgctgtcccagcagaacttgcacccgggacattcacagacggtgcagccagcgtggcccgttccacaccctgcagatgcctgtagcaccttcaacagattgtgtggtctgtaactgcgtg

SEQ ID NO: 393782 - DNA, 421 bp, Homo sapiens
atgttctttttgtcatacaaacaaaatttggttctggatggtcatggaagtaggtaagctaaagcatatagaatttaaaagctgaagagactggaaaattagagctgtcttcctgaaactgagtaagttcagttgatttttgaggaagtcatgaaatttggggagggttactggggtgatttcgaggagacccagagaaaaggtttaaacacatttttataacttaaagaaaataatcaaagtatgtttaatactgtatctaaaagtgtaacattgaagccagacaagagtgaattcaaaacccagcttccagggttgcttctcatttcttatctcatttattattgcacatgccaatttaatggcaattgcacatgccaatttaatggcaattgcacatgccaatttaatggcatgtgca

SEQ ID NO: 393783 - DNA, 412 bp, Homo sapiens
cttaaactcttttgggatctatattaggtgccagatggtcataagaaaattatgtgagatactggtgaataaacaagcaaaccagaagctaggttttcagaatagatgctagccagtagttcacaggcattatccagcaactggtggggatctacttggccagcccgtgaccactgagatgtgaacttccctggaccttggcagtcaagagggagagaggcagagaaagctccattatcatcactaattcccttttgaccacacgtgacagcatgacctgcttcaaagaaataagataaatggtggttaggtgcccccacaggcccacagtagcccattcaacaaagagcaaaagtaaaactattcctgatggatttagcaacatcatagttcacttgtgaggcaacaggct

SEQ ID NO: 393784 - DNA, 495 bp, Homo sapiens
agcctccgcctcccaggttcacgcgattctcctgcctcagcctcccaagtagctgggactacaaacgtgtgccacgacgcctggctaatttttgtatttttctttagcagagatggggttttgccatgttggccaggttggtcttgaaatcctggccttaagtgatccacccgccttggcctcccaaagtgctgggattacaggcgtgagcggccgtgcccggcctggattaactttttagcatcagttgctacttgagtagcattttctgaaagaagagtggctccaagtatttccagctcttgggtactttggattgtgtgtggaactaggaattttgagcacagtgattgatcatggtaatagaacctcactttctttcttcgtgtttcctgtggaggaggtaggattttcttacataggaggtttgctctgaaggaggctgcattgtttttcatgtctctgtgacagttcagagggctggcccttttccct

SEQ ID NO: 393785 - DNA, 414 bp, Homo sapiens
tatgagtggggtcggtctgcaggcaatggattagatgagctcccagaagggccggccttgccacagaaccatcctcctagaaaagcccatgctcatttacatctttttctttttttaaagagacaaggtctccctctattacccaggctacagtgcagtggcacaatcacagctcactgcagcctcaaactcctggactcaagtgatccccccacctcagcctcccaagtagcttggactataggtgtgagccactgcccctggccccaattccaccttcatgagaatgggaagcccctgtttaggagcaaggatggtaaaggaacatcttgtaggaagtaactgcaaccagccagccagtctattgctcttctgagttctctgggcagattccaagatgaactgaccagatga

SEQ ID NO: 393786 - DNA, 280 bp, Homo sapiens
ttgcctttgatttgtgtttgttgtcaatactttgtgcattggtgtagatctaggttttttaaaccaatctgttggaacattcgtgttccactgttgtaaggtagagtggaggtcacataagtattatacttaggtggcctaacaatggtggcaaactctgggttaaacgtagataaattgctttctttgtaggttttcccaaggcctttactatgctaatgtgcaataagtagttctcaaagagtgggatctactacgtacaattcctaacttaatttag

SEQ ID NO: 393787 - DNA, 334 bp, Homo sapiens
acttcttggaactttcagtcttcctttctgtaacaggctacttaactttttacaaaatttgtttctaatcaattgccataggctaggagaccccacctcctgttagaactatctgaattaggagtaaatgagatctgagtcttttctgtgaataaatgcttcctggaagcatttttgctttgtggttgaactagaaatggctagctatattggataaacattaggtaaagatcttcaggatagaccgcgcacagtggttcacgcctgtaatcccagcactttgggaagccaaggcgggcggatcacctgaggtcagaagtgcgggaccagcctg

SEQ ID NO: 393788 - DNA, 476 bp, Homo sapiens
ccccagctgtaagtaaatgtgagttctgtggtgtgtttcatacagggctccacctaagtaagaatgtgacatggggaccctggccccaagtcatttggtgccctgccaaggtaggatgctaacctcagctgcagccaaatacctcagattccctcctcaggcagcttcccagggacttaaaagaggtagcaggcaccatgaaggacattactgagcaccccccaagcgtgagatgaagcctgccacgaggcactgtgcacccaggcgctgcgcccagcaggcctgcagaaaaccacaaggccaggtacccttaagacgacagcaaagtgcaggcgcactgccagctgtgggctgggacccagccacagtcttaccacatcaactagcacattctgactctttctaaagccaacgccccttccgagtcaggaccaacagtgtttccaccatcatgtgaaaagaggaaaaactgaagc

SEQ ID NO: 393789 - DNA, 199 bp, Homo sapiens
ctttggagcagaaactagatgatggtgggtcaaggagtgtagatgggtgaaaagtagagacaactcctttgaaaaatatggctgtgagaacgagttgagaaatgggactagctggagaggaatgcatggactagaacatatattctgctaatgaaaatagcataaacagaaaaggagagagatgactcagaagaaaggg

SEQ ID NO: 393790 - DNA, 327 bp, Homo sapiens
gacctctgaccatcaggcttctgggaaccataggctatacccacaccacagagcatcgataaactattttgatgtttctcttgctttcagaaagacagcttccaagattcaagcccaggtggtgccggtctttttttggaggtgctaattaataatttaacttcatctaatgataattttatcttgttgcagtttgtggatttatgattatctcatccatccggtgcctagtgttgggcatagagtgtgtctctgctgtctgccagaatctgctactgggagaatttccccactgggagagggacccaggaaatggcatggtcttag

SEQ ID NO: 393791 - DNA, 1013 bp, Homo sapiens
ctcgaactcctgacctcaggtaatctgtccacctcggcctctcaaagtgctgagattacaggcgtgagccaccacgcccggccagaagtcctggttttgatctgactgtgtgcttctgctcctcccgccaggtcaggctttctgacagcaggaggtgggcagcctctgcactgctctcaccctttggcccttcattcctcctggtacactcagaggcctcacacttgcctccctctgtgggagttggtcaatcattaacccttgatgctgggaagagcttggtctcagtctcttgggctgtgaaggaagcaggtggtgttgagggagagtggcgtgggctggctctggccaggacttctcagggcagagtctaggaaggcgagaaatcaaatcattccagctgaggcaggagaattgcttgaacctgggaggcagacgggttgcaagtgaagccaagaatcgtgccaattggcaactccagacctgggcgacagtaaccaagactgcggtctccaaaaaaaacaacaagcaaaaaaagggcgactcgcagcaaccataattcacacctcgaaggggcccaaaaccaaagcaaactacacaagtatcttgaacaaatccgggccccctacaatgacacacaataacacggcatcggacctcggccggccctctcacccacctctggcactggcgcaaactccgcaacattaggacacccggtaacatggaaaaccatactcagtgaatggacacaaccagtcacaaaaaaacaaacaaaacataacacataaagcgaagcataaaccacacacggaattacctatcacaaacagactagtacccgcgcaccagaacacaatccgcatcaggagttcaatcagaccacaaccacagcaatcaaaaaaaacaaaacaacaccaaagataaaccagagaacatagaaacactaaataataagcacaagcacaaactaatagcaacacaagatacataacaacacacacaaacaaaga

SEQ ID NO: 393792 - DNA, 238 bp, Homo sapiens
aattcaaagcttgaaaccaaatagccaccgggttcgagcctatcttattctggtggtccactattaacaaaaatgtagactggataaattatatatactacaatcaggagcaatttgtcaattataccagagatgccataaaaggaatagctgaacagttagacccaacgagccagatggcctgggaaactagaatagcccttgacatgatgttagctgaaaagggcagactttgtgt

SEQ ID NO: 393793 - DNA, 474 bp, Homo sapiens
actcttccaagacaagtaaaaatgactgccaaagaaatggggaaaaaagattcagagagtgaaaacaattaatatactaacaagagagcaaaaagcaaagggggaggagaaactaggaaaatcatatatgggctctcacctatttccaaagctgggctaatgtccttttgcttgtgtctgaataaggcaccaattttaagctgctaatgaaaaaaaaagaaaaagagaaagaagcaggcccaggctgggcgcagtggctcatgcctgtaatcccagcactttgggaggccgaggcgggtggatcacccaaggtcaggagttctagaccagcctggtcaacatggtgaaacaccatctctactaaaaatacaaaaaattagccaagcatggtggcgcatgcctgtaaatccagctactaaggaagctgaggcaggagaattgcttgaacctggaaggcagagaatgtggtgacct

SEQ ID NO: 393794 - DNA, 892 bp, Homo sapiens
gtagaagaaagggctttattcggctgggagcttcagcaagactcacgtctccaacaaccgacctccccaaatgagcaattcctgtcccttttaagggctcacaactctaagggggtccgcgtgagaggatcgtgatcgactgagcaagctgagggttcatgactgggggctgcatgcactggtagttagaacggagaagaacaggacagggattttcacagtgcttttccatacaatatctgtaatctatagttaacctgaccgattaggtcaggggtcgatctttaactaccaggcccagggtgtggcactgggctgtctgcctgtggatttcatttctgccttttagtttttacttcttatttctttggaggcagaaattgcgcataagacgatatgagtagtggtctcctcccttagctaaggactctgactcctccttctgtggggctccatgtattctttctcattggcaacactgggaatagcagggcccagttgagtttggagagtgttgcttagtgctctttagttgcaaccatctgaaaataacatgaaaagaaaggggaatttcctgaaaaatgttggtggtagcaatgagagcaaggctcaaagaataaactggaagctgagaaactaggcttgaaaatagaaatcaaagggactggggaagcaaggaccctgcattcgtctctgggcaggaagggttcgctcagcgcactggtgctgcgataaatatcatgtgcctctgctgttctctcatcacggatcaagagtccaagcctggagggagagcgactgacagccatggtctggtcacacgcctgcctgagagctgcacgggagccggcgaggaaaagcccttgctgcttccagtgtaaggcaggtgtct

SEQ ID NO: 393795 - DNA, 498 bp, Homo sapiens
accacatctgctggaaggcattggaaagtaccaagataagcaggactccagggattaagatcccagaggggaaagtacaaaaagtaatacgaacagtctgagctgctttgtccttgaagcatttaccaatttgtaagtgacacaggtggagaagcagaacagaaattggctggctagagaccaagaagctaagcagagctattggcagtctcagggtgctggggaaatacaaattggagtgcaggaccaaccaaaatgacaaggctctggtaaaggacttgcctttaggctggaacttctgaaggactacactctaggagtaagggtagaccaatatagactagttttacaaagactaaatccagcttcaaattagctcaatccctaaagtgaaacaactatattgtaattaccagcttaaagaaatcttttccagaagaaaataccttcatccaagctgctgtagtttgtcatacacaatgtctgtcattcaataaa

SEQ ID NO: 393796 - DNA, 319 bp, Homo sapiens
gctactcgggaggctgaggcaggagggtcgttgaacccaggagattgaggctgcagttagctgagatggtgccgctgccctccagcctgggcaacagcgagacctcaactctgaaaaaaacaaaagaaggagatgaaatttacataacttaaaattagccattttgaacggtacagtgaagtggttttcggtgcattcaccgacttgtgcaaccatcactgctgtccagtcccagaacattccatcaccccaaagaaggaagccccatctccatccatcggccatcaccccctgccctcccccggagcctcctcggcaa

SEQ ID NO: 393797 - DNA, 122 bp, Homo sapiens
agggatggctttctgggagaatcaaaacttgaggggaaccttgaaggatggggaatagtcaataaatcaggagaaaatagtgatggtgcagggcatttcaggatggcttctccaagattcat

SEQ ID NO: 393798 - DNA, 437 bp, Homo sapiens
cttagaaagacagagagatccattcagcttccaggaaaaggagacattttggagagcctgccaggtacagtaagcagtatttatgttacactgagggagaagagcattcttaacttggtccagcttgttcagatgtttagggtcaaaagagcctggcgtattctgagtattacaagtagttttgaggcttgtaaatcatggggaaacttccagtgagctgtgcactggtggctcatggctgtgaggtgttggactttgccctgagggtgttggggagccagactgcttccctgtcctggctgcctccctggtggaatatcctcccagctgtggagggtaaatgcgaatgggcgaggggaggctggagagtagagagaggcccagagtcccgtggaatgagtgaagtctgagcaagattcatggggatggagtacgga

SEQ ID NO: 393799 - DNA, 353 bp, Homo sapiens
agtcgacggagactctctgtcttcgtctcgtctctctcgtctcgtcgtctcgtctctcctcgtctctctggtctgtctctctgtctctgtctttctgtgtctctctcaacgtctctctctgtctctctctgtctctgtctctctctgtgtctctgtgtctctctgtctgtctctgtctctctgtctctgtctctctgtctctctgtctctctgtgtctctctgtctctgtctctctgtctctctctccccccacggccctgtgcccctcagcaaagcttcttcagaacagctctttggacagcagctctcagggcatctgtagctggtgccagcctacaccccccatgcagct

SEQ ID NO: 393800 - DNA, 574 bp, Homo sapiens
ccccacagctggcatccccaaggctggcatccccaaggtcagcatccccaaggctggcattcccaaggctggcatccctatgtgctttctacattctggacactgtgttgagtgcttcacacacattagcacacagactcttcacagccaccctgagaggttatttactatggctaccttcattgtacagattaggaaattgagacaaggagaagttaaacaccttccccagaccacacagccaggactcaaatccaggcggcctgagagcccacacacttagccgtggtatgcaaacccaaaagtcactcctccaggaagtcctctctggcctttctcagagagcccacagtgccctgtgctctgtgatattatgctccatcagagcactgtgatattatgaggtagatagatcagatgatagatagatagatagatagatagatagatagatagatagataatggatggacagatggatggatggatggacggatggatggatgaatagatagataaacagaatagaatgatagagagagagagagagagagagagagagagagagagagag

SEQ ID NO: 393801 - DNA, 157 bp, Homo sapiens
tctcttgactgtgggtagatgtatcactgcctggttgtgtgcccaggtaagtcactttccctctctgctgacttctctagaaggccgactctccctaggtagactttactaaagcccttactgtgggcttcaaccttcttggatacatctgctactt

SEQ ID NO: 393802 - DNA, 261 bp, Homo sapiens
ctcaacagttctagagactgggaagtccaagatcaagacactggcagattccatatctggggagggcccacttccaggttcacagacaacgatcttctctctgtatctttacatcatggaaggggtcaggggtctcttttataagggcatgaatcccattcattatcttatgatctaatcacctcccaagggccccaacctcctaaaacctcgtcatgggagttaggatttctacatagaattttgggggaacacaagcat

SEQ ID NO: 393803 - DNA, 577 bp, Homo sapiens
tcacctaatttttcctatatatatactgagcttttcttaagaaatatatttcattatctcccacatgaacgccttctttctatgacatctcaacctatacgggggagggggagagacatggaatctgagtattagtatcttttcagcaacacagatgcacttcaaaaagacataacatacaattggaaagacttcagaaaagacatctaaatatttataggaatcgaagtccagactaaataaaagggacttcttcctagaaaaacaaaagctgagagagatggttaggtctataaaattaagtcaaatatcaagacaaatgaggtgaacgcaatcttgtctgccagaacctagaagactaagaagttgaagttcaagagttttttaaaaaattaccctaaaaacatatatattattggaagtgttaatagaagtgaaaatatagattcaagagaagtttcaattcatgatggttagattcatgaatgattaatgaaagatgttcatttctggtacacataggatgtaattacaacaatttttcacaaaacataccctggtaccatgctgggccaga

SEQ ID NO: 393804 - DNA, 248 bp, Homo sapiens
taaaagcaaataactccttatcttaaaaataaacagagatgagatagaagggtcagtgtcaaaaaatcatcagcagcagatgaaggacgggggtcagacacgaggagctttttttttttttttttttttttgagatggtgtctcgctctgtcgccgggttgttttgcagggcaaaaatttgggcccattgaaactttaacttctgggcctaaagggatcttcttgcctgggcctccaagggttttagg

SEQ ID NO: 393805 - DNA, 349 bp, Homo sapiens
gattgggttcccaccctcaagagctcacattcaagtgtggtgacatgaggtgggcaatggtagcaaatgctcattttgagggatatgttgtaatttccaaaatgctttctagataatattactcaggcctcagaacaacccagtgaaaaagtagacattattatccccattttacagataagaaaactgaggccctgggagagaaatgactcagtcataatgactgccatttatgaaggaccaattaagtgaagaggaatcaggctaaacattctacacatattgtctcatttaattcctttaacagctccatgaagtaagacttattgtggtgtcacctgaggaaact

SEQ ID NO: 393806 - DNA, 673 bp, Homo sapiens
aagggaagtgggcatggcccccggaagaggacgcacatggatccgccctctgctggaatttgtgcatgtttggtgaaaacccctcactggggctttggagggagggcaggtcccagggctcaggggttggggtcatttccaaaaacaaggctgcttacactttcccaaagcacccacatggcagaggagagtcaacctgtgccctggcaggactgaggacacagctaaaagctgtgaaaaaagcttaagtctcatttccttttgaatctcaaaaattcatgccaattctgcattctgctccaaaatagtacctttttattttatgatgcaagtaccctactctgatccccagggcaatctcacacactggtatgagaagctcaaatataaaaattaagcatgaaacctcaagagtggataagctgaccttgagggcgtaggtggagaaaggccctagcctcccagaacaacacagctggaaccggcggggggagggttatggatcaaaatacacaatagccctgactgcaggccggatactctgccaggggctcacatccattcactcattcattttcctcttaccctctttaaaatcgtgtgcctactacgtgttagcactgttctcgacagatatagcaggaaacaaaacagacaaaatccttgcctttgg

SEQ ID NO: 393807 - DNA, 500 bp, Homo sapiens
cttttaagctatttgcttaattataagctatggttcatctgattccaattccatttttgtaagattgcatattaaatatttctttaaattatttaactttatttcctttgttcactttaaaatcaggctgatttgagagtttatgcctctgtacaatgaaaaattggaattgatcttggtgttacagcaattaattgtgaaatcacagctgaacctaattatcgtaaatattttataattaaagaaattttacccatccagcatgttataaatagtaagtggtcttcaaacatagctattccctctattccctcttctctttttatttttatttatttatttttttttggagacagagtctcgctgtgtcgcccaggctggagtgcagtggcgcgatctcagctcactgcagcctccgcctcccaggttcaagcgattctcctgccttagccttcagagtagctgagattacaggcacccgccaccacgcccagctaatt

SEQ ID NO: 393808 - DNA, 279 bp, Homo sapiens
tcctgcagcaaaggctcttgaatgggattgagtcatttctgtggtcccagaggacttaggacagtatatgacagtcatgactccttaaggatttgggggattaaagaaggaatgaagaggcaaaaaggcaattggctgtctttctccaacactccagggcctggtctactaggatgtgagaccctgaaacaccagttcctgggaagtcattgctgtgagggggttgagaagaccagttactctcctgctgcctttcccaccccaccccttttaatgatg

SEQ ID NO: 393809 - DNA, 642 bp, Homo sapiens
gtcttccttcccttgcttcccatttggttcagaagacacatgttttgtataattgagagtagcgatagaggggtgtgttctgaaattctggttaatttccctcagggaacaaaggacagcagagagcatggcttctactcaccagaatagactgcattgctttcgtagatatgtgaactggccttgatgtctagggttatggtgtagtattcatcaaaggtgaagcaggtgctactgtaccttataaaggtggcagaagaaagctgcagactgaggcacagaaacatccccagtggctgcagcagcatgtcatggaagactgccatggtctcagtctgtttggaaagtgctaggcctggaattgggtgaaactgacaactcacctcttgtttatatgccagggcttctgggtgaagtcatacatgcagatcttctccctgccccttctgaatatacattggattctggaatttggcccaagacatcaccaggaatgaatcaccagtcaccattacctgtcaccgatgattttgcaaattgcagttttgctcaagaaagggaatgtcctgaatatggttttcttttacgcctgtcatttcagcatctgctgtttgaagaaagccattgagaagatgtgaatac

SEQ ID NO: 393810 - DNA, 197 bp, Homo sapiens
agccttctgaaaatggtgttttgtaagatatctctcctctatttttaccccgagttctcctcccttagttttcacaaggtataccctcatcacctgtgatcataaaatctccactccattaccaacaaaatttgattctcaaatgggttttaagttgtacccttatatgtcaggaagcctaagattttgatatgcaa

SEQ ID NO: 393811 - DNA, 509 bp, Homo sapiens
gtgtgtgtgtgtgtgtgtgtgtgtttaattcaaattatacacaaggagtttgtgcaggctttctttagaggcagaagccagttaggcaggtcaagaataatataaaatcacaaatgaagagaataatgtgtttatttttcatttgtcatttaggactgtctgggggagactgtcctctcttgggtgggggcgtgaaaaggaaagaaccatagaaaaggtgaagcgtagaaagattaggcagggggccatttaaggcagtgcttctgaagtacctgaggattttgttagaatgaagcttctgatttccgaagtctgggttggagctcaaggttctgcatttctaatatgccttacatgttcccagatgaagctgacagattttgctttgaaaagcaaggttttaaagcatagttggataccaacctgttttaccgggttctagctagtttttggaagtatagactgtgggaatcattctcagccataaatgttagggaaccctagagatt

SEQ ID NO: 393812 - DNA, 426 bp, Homo sapiens
taactgggataacaggcatgtgccaccatgcctggctaatttttgtatttttgatagagatggggtttcgccatgttagccagtctggtcttgaactcctggcttcaagtgatccacccaccttggcctcccaaagtgctgggattacaggggtgagccactgcacctggccattactgcattattaatagaactggaaaactaaggtaccagtggagggactgtcagaaaaaagcttaaaggatgataaagatcatctcttcctctacaggcaaggagtctttgctttaatcagaacatctgagatgttctcacaaatacattccgctccttctggttcatgggatctatggctctgaccagcctaaagtggccactcacctttaaagcatgaaaatctcagctttcctctaagtctaccttgcc

SEQ ID NO: 393813 - DNA, 384 bp, Homo sapiens
tactgcccaggtctctcttgctcttttgattattccttgttagcctactatgctgataactttccccatgtgccccatgaacactagtatttcccaccattacatccaagctttcatctgtcaattcattcaatgaacaatcaccacctacttcattccaggaggacaactttgtcagatccccatttgtcaatggttttgcatgtgaaccaatgctccaaatcacttgcatcaaagaaacaaatgctgccttgccgcggtggctcacacctgtaatcccagcacttaaggaggccgaggtgagtggaccacctgaggtcaggagttcgagacccagtcagaccaacatggcaaaactccatctctactaaaaatacaaaaatc

SEQ ID NO: 393814 - DNA, 334 bp, Homo sapiens
cccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaag

SEQ ID NO: 393815 - DNA, 410 bp, Homo sapiens
agaagtggagagagctttagaagcatggcacaaataaaaggaaagaggcaaacaccgtcattctacatctgtttattttgttattaacaaaaggcaaggcgattttcattaaagttttgctggggttggggttgagggtgtagagagcaaaagtgtgagttgtacaccatgactggaatcgcttggacatactcttcagcagacatcgtgtgactgtggaagaaatgagtttcatgaagatgactgatagaaggaagccactgaaccagtcctctatcacctcttccaaggctaaagtttggagccacttgcagaaggctctcctcaaacccctgtgttctttgcctacccctgctgttgccacatcatcttggagagctggctgcttccctcctcaactagaagttcct

SEQ ID NO: 393816 - DNA, 504 bp, Homo sapiens
taggcactgcctccttggaaggctttcccacggccaagccaggtctcccttctctggtttgctgggtcctatgcttttccccatcacaacataggctcctgtgttgaaatagtctttttactcctggctttggaagaattacccaggttgcaaactctctgagggcagaagtgcatctctccatgctcccactgtttcctccgggcttggtgcagagcaggcactccgaatatttgctgaatgaataaaggaatgaggacgggtgcctcctacccacttcctccctctcagatggctgccaggacccccaggtatgatgatgggcccaagttgatgagttgatgagacagcagaaccctttcagggagtgatggatggtgaggctggcactcagcacttccagctggtgcatgagttttaagaacggatgtttgtgacaattctgattacgttctagtttttgaaatgagtcatgttggtggtggccatcctgcccattgggac

SEQ ID NO: 393817 - DNA, 588 bp, Homo sapiens
ataaacctagaaagaacacagagcaattctaagtgaatgagtgtgttttatagctgggccggtattatggccaaacttaggctgggtgagaagtagaacagatcatgatacctagcagagcaaactcggcaggcggaatagaattcctagaaggagttattttgtttgtgaccagggctgttgaggattcctcaagatagggcctcaggcatgaactagaatactggaagggaaccaggggttgggggaaaggggtttgggcagagccgggacaggtaattagttaaagtcacacataattgcagaggttgtgtgtgctgctagaatcacagccgtcacaaagaaggtgtggtgccaaggtgctggccgaggactcctgtgtgtcccctggtttggattagcgctgaccaaaagtgcccgagtcagctttcacgtttccaagtgggtgaggcaggatggtgaggggtatttgcttggtaccgcgaactctgtccagacactgaaaacatctacaacagaagatgaggaactctacaagtttcctggaatttttgctggttagaaaaggaatatgtgtttggttatgtc

SEQ ID NO: 393818 - DNA, 691 bp, Homo sapiens
gccaggtcatcttcatcttttcttagctaactgaggaggacagtcatccaagctggggtctcctctcctgtgtgtctctcctagggatggagttgccaggctttgtgcttgttttacttcttctccagcctttccttcccctccctttcctgttccctaggttggtcatagcagaggttgtgttggagggtggtactggcttttgggaaaaagaggacaatccccatgttcttcaacacggctgccgcaaacactacccagaaacaggctgggaatggggacttgaatgccagctgtggggtgcctgccttgcagccagctctgccaaagcttgtggttatgattgtctcctttcttctgcttcacagccagtcataaatgccatcttccttggatgtctgagtcccttggaaactgggctctgaactcgattccactggggttaaccatgggctatgctatcagaatttccacctaggcctccagtttccttagagcaaaaggaaaacaaattgtgaaaggggagtagcagagtgggaaggtggtctaaggacagctgttctgacctgagtaatattacatccctgatgggaggcagcaagtgcagcaccttccacacctgaaaccatcacttaaatagcgcttcatggtttggggactgtgacagtttcctagggggctataacagagt

SEQ ID NO: 393819 - DNA, 186 bp, Homo sapiens
agcttccagctctaatcagatgaaaagccagagagaaactttgtcctctcatggtggtccattagtgtgattaataataaatattcccagacacttgatactggcaaaatgccttatcagccctgtttatgattacccacctgctatctcgaaccattagtctgaccactaaggtgcgggggtgat

SEQ ID NO: 393820 - DNA, 243 bp, Homo sapiens
ctgtgattatgattgtccagcagagcccacctttaaacaagatacaatccttacaaatgccaagactgaggaggggttttcccaaaggatccactttgctacagtattgtgtgtttgtttggccatcagagaatcagaggagggaggtgtccagccagacacaagccatgaacactcgtgcctgcttccaagggctctggccacaaggtggcaccatgcagcaacgcgtgtccctccagttgt

SEQ ID NO: 393821 - DNA, 829 bp, Homo sapiens
atttctaaaaatcgtactgacctggagtgtttttaagaggggctaggaaagaatagggtagtgatgcctttttttgggggggaaatatgacttttattataatgttaaaggaagaaaggtagcagagttagaaaagaaatagcaaaatgggccaggcgtggtggctcatgtctgtaatcccagcactttgggaggccgaggcgggtggatcacctgaggtcaggagttcaagaccagcctggccaacatggtgaaaacctgtctctaataaaaatacaaaaattagccggccgtcgtgttgcatgcctataatcccagctactcaggaggctgaggcaggagaattgcttgagccaaggaggcggaggttgcagtgagccaagattgtaccactgtaccccagcctgagtgacagaatgagactccgtctcaaaaaaaaaggaatagcaaaatggagatacacatacatagatgtatgtatgtgacaattctgaattagaagactaagttaaagtatttttacttgttcacctcttctactggtacacattgagtgagcttacattatttgtagattgtctttgacaggtttcagagatgggtaagaataataatctttggcaaggaacagaaacccttagggcagggggatttggggtgggggaaggaaaaaaaaagaagaagaagaatcttggctgggtatggtggctcactcctataatcccagcactttgggagtttgaggcaggaggatcacttgaggccaggagtttgagactagcctgggcaacatagggagaccccatttttataaaaaaatttaaaatta

SEQ ID NO: 393822 - DNA, 477 bp, Homo sapiens
gacccatcacctttttgagcactctggggtaatagactttatagtcctcttaggttgccaaatgctttcctaactcagaaattggaatatcgcatctgtgtgagagtgaaagctgtgacagttgctcactgccctgtttggccctccagagttagaacaggaggagggagccaagacagggagggagcagagatctcagccctccataggaattgtcctgtcggccgcccttcctgggctcagccagggctttgttctcattctctcatggggtactttcaggaatctttgaggccccctctgtctccccacttcttgtccccggctcagggccttcccatgtaccttgaccaaggcagctcctgggatgtgctaatgctgtcgcctcccaccacaacttcctcctttgcagctcgtaggaagccagtgatagctccagcttctttctactgagccctgtccacacccctaggtggc

SEQ ID NO: 393823 - DNA, 369 bp, Homo sapiens
gaggtgaggtgtggcaggtgggaggatgagtgtgatataaagaaccagggctttttgcagccagcactcctgagtgcattcttgtctgcagctgtgagcttctgtcttcccatgtgcaaaatgagaggataaggagacagtaatgcaccagaatagcttgctcactgctgggtgaggtggctgatgcctgtaatcctggcactttgggggaccggggtgggcagatcgcctgaggtcaggagtttgagaccagcctggccaacagggcaaaatcccatctgtactaaaaatacaaaaattagccgggcttggtggtgtgtgcctgtaaccacagctacttgggaggctgaggcagaagaatcacttgaa

SEQ ID NO: 393824 - DNA, 317 bp, Homo sapiens
tgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaaccc

SEQ ID NO: 393825 - DNA, 294 bp, Homo sapiens
cagggaatatcactccaccatccatttaacagtataataagggaatcttgtcaacaactttatgtttataaatatgacaacataggccaggtgtggtggctcatgcctgttattccaacactttgggaggccaaggtgggtgtatcacctgaggtcaagagttcgtgaccaccctggccaacatggtgaaactccgtctctactaaaaatacaaaaattagtctggtgtggtggtgcacgcctgtagtcccagctactcaggaggctgaggtaggagaatggcttgaacccagg

SEQ ID NO: 393826 - DNA, 281 bp, Homo sapiens
accctgtaagctgctaaaccgacatggactccaagccaaagctgcataggcctctaggcttttaaacatgtggctcctgccgccctgcgggtggtattcgaaatatttatcaggtgcatgtatacacgtgtggacaggctgagcatcagcaattgctgcctgccctcaccaacttgcccctcaaactcttacccagcttttaggacccaggacaaaagtcactccctctaggaagccttccgggatcctctccctcctctgtctgcgccatgctctgcccc

SEQ ID NO: 393827 - DNA, 263 bp, Homo sapiens
gacatcatgcttggctaatttttaatttttttgtgtgtggacacaaaaaccgactaggtttcccaggctggtctagaactcttggcctcaagtgttcttcctgccttgacccccaccctctccaaccaagcactgggattacaggtgtaatgacagggagtcatcacatctggcctcccctagcatttagatattaaactgttggaaaaatgagtaaaaaataaatgtaagtagcattttgagtattttcttcccatacaccc

SEQ ID NO: 393828 - DNA, 137 bp, Homo sapiens
cttttttaaaataaactgtatgatgcttaaaaaaccaacttttactttatagaatattcccttttcccatccagtcccaactcttcaagaagtattttttcttctcaaatcatctgaactttaaaatttttttttgt

SEQ ID NO: 393829 - DNA, 222 bp, Homo sapiens
ttgaaatgtatgacatgagggcaaattctttccatgtttgtttactcccttgtacttcaaggtatggaccatcttttacctatttgttggggtatccaagtttgttgtataaatctagatgtatagattctagatacaacatcgtaacttcccaattacttggtttttttaattgttactataaatactcttctaaaggttctaagttttgttttgtttttg

SEQ ID NO: 393830 - DNA, 545 bp, Homo sapiens
  misc_feature (338)..(338): n is a, c, g, or t
  misc_feature (481)..(481): n is a, c, g, or t
gtgggaggatgacatgaggccaggaacttgagaccaacctgaacagcagagcgagaccctgtctctacaataaaataattttaaaaattagctgggtgtggtggtgcacagctgtagttgcagctacttgggaggccaaggtggaaggactgcttaagcccgggaggttggggccaccatgagctgtgatgataccattgcactctattctgggcaacagagtgagacccctgtttcttaaaaaaaaaaaaaaaatttttttaaacccaactttacaacttttttaaaaaggtttttaaaacagaaagaaacaattcttaaaatgcaaaaaagcaacnaatctcacatcagcacaccgtcacattcctctgaagtcagctatactaaagctagagaatagattatccacatgaaagtgactaaatacgggcattggctgtgtaagtacaattagtgctgtctataaatgccgttttcaaanttaatttatcttcatagcagttcagcaggcaagtgtcactgacgctatggctgtatgacgtgca

SEQ ID NO: 393831 - DNA, 206 bp, Homo sapiens
cccaaagctctgggaggacatagtattcattcctccctcagcagaagcggtgaggcaagaagctctggggagcacccagccttggacttttagcatagtgtgtcaggtcttcatagtttgggcccagggcacagagaagtcacagctctctggcatcctgtgacctttaccctctttgccaagggaaaatgtggcccaccaaagca

SEQ ID NO: 393832 - DNA, 160 bp, Homo sapiens
aggcccaaagggaaaatcgggggaatttctgatattcacagagatgtgataagtggatgtttttgtttgtgggagaagacacgaaggcttgtgttacatgttttgtaatttaattgcataatttgcacaaaatttaaaactcacacaaaacaggaccaaa

SEQ ID NO: 393833 - DNA, 523 bp, Homo sapiens
gttctctcttgcttctgctcctgccatttgaaatgcttgctccccctttgccttccaccattattggaagcttcctgaagcttccccagaagcagaagcttctatgctttctgtacagcctgcagaacagtgagtcaattagacctattttttaaaaattacccactctcaggtgtttctttataccagtgtgagaatggattaatacaacctacactttagactaaatggttacccatttagtctaagacatatatagaacattccatccaacaacagcagaatacatgttcctcccaaaatgctgggattacaggcatgagccacagcacttggcctatatcccctttcttttggctgatttctccctttggaatgggagtatttaccaaatgcctatattttcattgtatcttggaggtaactaacttgtttttgattttacaggtccataggcaaagggactaaccttgtctcagaagagactttggacttggacttttgaattaatgctagaatgagt

SEQ ID NO: 393834 - DNA, 437 bp, Homo sapiens
tctcacgcagccatcacctcaagctgctgccccctctcattccgctcttcccgtttgccttgtgatttaatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtctcatcaagtctgaataggacaagtggagatgcactctgataggagtttcttgcaatcaaggactgggctcagtgtttgtctctgtgcctggcatagagtagcaataactgcacttactattctcgacacttcaatcaaagcacttagcatattaattaattacactcacagcaagaccccaaaag

SEQ ID NO: 393835 - DNA, 477 bp, Homo sapiens
cttacacctcagtagtacaagggctttaataagaatttgccccttttttgggactataaggatcggtgagtgttaactctgccctaatgatgacttaggaatgatgccagcggttccataatctcatgcctagaagtatcaacagagggtgttgcaggggtgggggtgaaggattgaccactccggcaggtgccatacgaacgcaggccctcccccgaaagcacagtcatacaaagacacaaaagtttgaggatgtttaggggtaggaaataggctattcctgagttcttaggaatgagtagtaataaagctcaaatcacttgaacaaagccagcttaagaattcagatttcccgactgtgcctagcactcattccactaaaccatactgaaaggcaagacagaacacagagacaaacagctagagtgcctggcttggcagtctgagaacacagtactactgagttaagggaaccag

SEQ ID NO: 393836 - DNA, 305 bp, Homo sapiens
gttagctttttactactcattcctaagaacgcaggccctcccccgaaagcacagtcatacaaagacacaaaagtttgaggatgtttaggggtaggaaataggctattcctgagttcttaggaatgagtagtaataaagctcaaatcacttgaacaaagccagcttaagaattcagatttcccgactgtgcctagcactcattccactaaaccatactgaaaggcaagacagaacacagagacaaacagctagagtgcctggcttggcagtctgagaacacagtactactgagttaagggaaccag

SEQ ID NO: 393837 - DNA, 766 bp, Homo sapiens
gcagctaaataagttaactgagaattacttcaaatttgttttccaagattagagataaaatgctttcatttttaaattaaagtttgctgaatgatatatggagtctcgttgagataaaccttacctttagaaattatgcaaagagcataggagtaatttggtaaaagatttctggggaaatgaaaagctttggaattgatcttaatggaaacagatgaatggatctgaagttatggaatacattggataaaaaaaagcagtttgaaatttgttccaaaaatttttcttgaagccagtgaacagatttagagcaaagtgatggaacagcaggaaagacatgtgctttcattaaagcatctagatttaatagggcaggcaaacaggtaagaatctgaaaggaactcgacattatggctgaaccagtagggatatttttcgaaaggagtttttaaagccaggttagaatagtttgtttaaaaaaatgtcgagagggagatgggtctttatttcattaagtattatgagacagcttctatgtgccaggtactaaggatgaaaaataagactctttgatacctatgaacaaatatgtatgcaaataagaaacttaaatacttataaaataattgctttaatagggggtatgtgcaaagtggggagaactttaaatatgcttaagggagtcagggaaggcttcacaaagcagattatatttgatattaaatatgaaggaaaagttttctaggtggacaatagaggaaggaca

SEQ ID NO: 393838 - DNA, 271 bp, Homo sapiens
ctacgtgtgtggtctttgggaaaaggctgcgtttgaggctcctaaaggtggagatgcccaggagtctgcagacctgacttcttccgggagcaggaacacaattcgggagaggaaggtgatgcgaggttgatggaagctggcgagtaccagtccctgccaccaccaccattttatcatgaacaattgtaagcacacagaaaagttgaaagaattcacagtgaacacccattcacctgctgtctaacgttcccagtgatgatttttatgcgct

SEQ ID NO: 393839 - DNA, 755 bp, Homo sapiens
ggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcct

SEQ ID NO: 393840 - DNA, 644 bp, Homo sapiens
tctaaagattttagagcatggaattgagtgcattgctttgacttactcgttaggcaatatagaagcattcataccttcaatggagtattgttccttctaacaatatcgacccactgctgaattcttctaatgatgttgctattatttggcatatcatgggagtagcttttttacttaaatacgtttagcactttctttttagcaactatttgattgggaggattaatatgatattgtttccagtagcttgtagatagttctaatatgaagaatcagatttggtgatcatcctgaataatataataaacaccagttgggctagtatataagaaaattgggctaggtaatataaccaaaagaaaaaaaaaaaaaaaaaaaaaaaaatttttggggggcttgggccctcggaagaagtttctctaagacccatcccgtgttggggcgcgcgggggcgcccccatagtgggtagtctgtggacaccttggcgtcatcagcggggtgtccccaaaggagaaaatccgtggtacgaagacaacgcgcgtgggggttctccaccaattaaaaaaccgccgggggggaagccggcgcgtccccagaacaatctcaaaaatgggcagtcccgagggcaccacgggcgttacag

SEQ ID NO: 393841 - DNA, 439 bp, Homo sapiens
tattccacagcagcaataggacactaatacaatgtgttacctgcagaaacatcagatgcactaatggtggatcagaatcgcccaggtggcttattgagtacaggtccccaagcaccactcccagatattaggattcattagatccaagtccagccttcgagcccgcattcttaacaccctttcttttccaattatctagcctgtaccgatgtagaaaggcttagtaatactcatgtaagaagatgaaatccagaaagatctgttgtttttcaaaagctgggtgaaggtttatggaatatgtttggcagaagtactaactaaatcataaataaattttttacaaaatcctagactattagagtggaacagaccttccaggatgatctagttcaatgcttgcattttacagctgcaggaactgatgcacaaggaagtccag

SEQ ID NO: 393842 - DNA, 430 bp, Homo sapiens
aatgcacagaaggaaagggatagcaaggggatactgtgccttggtaagcgtggtgccaccgcagactaaaagcagatataagtcaagtgctactgacttaagtttggcaaaatcactcctcacagcccgctctgttttagaaatgtttatatttctgatatcacttttgttaatttgaagaacttttaaaataccatcattgtttcaaaacaaaatgtggaaggtgtggatcaccttcctgaatttacagaaaagtttttgggtacatttctttgcggaagattggctgagatgtggttcacggcagggtggtgcccgtgccttgcggatcacgttgtctgtacactgactgacataccaacttagagtctttgaaaatgcccattggtaagtcaacattgttttccctgaaagtcctgagacagaaaaa

SEQ ID NO: 393843 - DNA, 476 bp, Homo sapiens
aacccggcatttcgctacctggcatttcggtacctgtcatttcgttacctgtcatttcgttactctggcacctcgatctttggctgaaaagtccaggcctgcccacacttggcctcggagtggccttagcccagcctttgaggcctattgtgtggtttttctcatcttcttattaaggaaatagcagaatccctggagctcacccggaaaatgtaaaccacagcgggaaattatgcaccacagtggatgcccagacagggggcacattctgaagcctggcggcctcaggcccagccttcgggaaaagctcactcctgtctcatgtgaaaatgctgttttgctggtgttcattggtcaccagtgatggtcactttcatgtcttcctttcagtttctcttctgccggatgaggcataaattctgatggaccccacctgctgtaagatctttcagaaaagactttgggtcagtctcctt

SEQ ID NO: 393844 - DNA, 630 bp, Homo sapiens
cataaatcaaatcatgtcactcatttgctcacaactctcaaatgagttctcatttcccctggagttgaagtcaaagtccttacaatgttctataagctttattcgatctgataatctctcaacttcatccattttttccttttgttcgctctgctccatgcactccctggcatacatcaaacaagctgatttcagtgtcttcgtatttgctattctttctgtctgaaatgttcttccctcagtttcctgcatggctcaaacctctactcaactgtcatcttacagtgaagttttaaatgcccaccttatttacagtaacagcctcacctcactactgatccccaactccaacccacattcttcattattttcctggtctccctctctacaaccaaatgtcagcttcatgaaggcagggatctttttttcactgccaaattcctcagcctctaaaacagtatatggcacataacaaggattcatacttcggtgactgattttctgctaatatatgactaatgacccctttgtaaatgccacataaaatctccaagttctgcatttacaacctaagcaacattgatcagcttcacacaaacttctgatctgaactggataaaaattactgag

SEQ ID NO: 393845 - DNA, 300 bp, Homo sapiens
acttttttttcgttgttgttgttgttgagacagggcctttttttgtcacccaggctggaatgcggtagcacaatcatgactcattgcagcctcaaactccctgactcaagcaatctttccacctccgcctcctgagtagctgggcccacagatgcacaccaccatgcctggctaattattttattttacttttgtagagatggtgcctccttacattgcccaagctggtctcaagcaatcctacttcctcagccttccaaagtgctgggttttcaggtgtgatccactgtgcccagctct

SEQ ID NO: 393846 - DNA, 669 bp, Homo sapiens
tcagcaaatttgtacaaatatacattttctcctgtgcgaatttcaaaaagctatattcattttgaagaggaaaataatatggcattaaatgctttgtattttccccttagttagcccttatggcaaaaatagttgctaatcactgatacaaagcaaaacgttatgggtactgataacaaagttccaaaagccaaaatgggatgaatcacaaacttactgtttttcactaaaacatgtaattggcctattacatcaatagttttaagtgggtaatgttcttgaacaatattagagccataaaattgaagccagtagcttgaacaatatggaggccttcttactgtagggaagaggtgtctagcttagaaggatcacatttgatctagatgagattacccatagcagggaaaatgaatcatcacctaccaaagactgtacggaaaggtgtgttattttcaaaattgcattttagtttgcacacatgtaaatgattattctatgttaatctaattgacaattcagttagctccgcatcctaagacttaaaactagcaattcctatgcaaatcatctgcttaactgaactacaaacgtttttcattaattcattctttgatgacatattccatgttatataataattcaaaataaagttaatatactacccca

SEQ ID NO: 393847 - DNA, 169 bp, Homo sapiens
caagggaaaaaagctccagaaagtcaatcacacaaatttctctatcctatattaaagacagaaattccccctcttccattctgaggcctttgcctctcatctcgctggcactttgttctgcttattttgcatatgtcatatgtatctctttttcatacatcttcaaaca

SEQ ID NO: 393848 - DNA, 244 bp, Homo sapiens
acccacctcagcctcccgagttgctgggattacaggtgtgagccatcgcgtccggcaagccaagctattattatttggcaggacattttaggtgctaatacagttttgtataaatattgtaagtatcagggtatgtgtttgttttacaaaacttaaggaaaacaaccctgtctcttagaactgtgtgtgttttcaagagtataatatttcttgccagtagataagatgcatgataggagggggg

SEQ ID NO: 393849 - DNA, 459 bp, Homo sapiens
atcaagagaaacgcatgaggtgatccaatcattgccagggtgggttatagaaaaaggaatccaaggatcaggtgtgggatgtgtgaggagagtgatttgtgaactgagatccacaacaccgggccacagtaggacttagcttctaattagagccttgtgtctgttgtcggggcatgaagactccttctagattcagctggtggctggagagattttgcacagtcctaaggggaagtcctaaggcatactcatccatctacccactcattgatttattcacgtattcaacagctagatgtggcgtattcattactcaacacctattaaggggtcccctacgcaccaggcactgtgtcaatgtcgagactgtgcaaggtcacgtaaagtttcatctttatcctaaaagcaaatggaagccactgaatgcttttacgaagagatgtaacacaatcagatggc

SEQ ID NO: 393850 - DNA, 322 bp, Homo sapiens
ataaacttgctgaatacttgaattctagagcggtaggcgctgttgttatgctctcccttttagatgagaaaacagcatctcagagaggcagatcatttccagagctagtggatgcccagtgtttatagcattcaccccatgccaggcgtgtgacagggcttttgtacatgtgatctcacttaagtctcaaaacatacctgtggttaggcctattttatggagagctacgagctagttagaagtgtgataccattttacagatgaggaatcatttcactcactgtgaagtgcaaagatttcccagaggtctcatagctgaagt

SEQ ID NO: 393851 - DNA, 747 bp, Homo sapiens
gaaatggactcttgagtgattcagtgagatcatacaataaatggcaacctggtggtagaaggaaataatcttagttatttcctttccaagtgaaaggaaaagatctcaaataattaagcttttatgaaacaatacaaaggagttgattattagcatggggatttgtccttagactaataggattaaaatttaagaataaaatggaacatgaagccaaagaaccaagtgtatgttgctttcaaatattttgcaaaaaatttgaataaagagtctattaaatagaaaagaagactaagattttatccaactacttattccttataagaagtaagaatatttagagaatgaagaggaataaaagctgaatgtcttagcaaaacttcactgctcattttaatcttatatatgaagtttgttatatgcttgcctttaaatgaatgacctttcagtgccagtgaagtcaaatatcaagcagtaaagccttaagtaacaagaaaatgccagaagtgagttgatctggctcaactctagtagaattctagaataaacttagtttgaatagaactttcttttgttgctgaaaagccattgaacatgtattcattttcttcccttagaaataactgagcctcggctgggtgaggtggctcatgcctgtaatctcagcactttgggaggccgaggtgggcagatcacttgaggtcaggagttccagaccagcctggccaacatggtgaaaccccatct

SEQ ID NO: 393852 - DNA, 543 bp, Homo sapiens
gagagagagcgagagagagagagagcgagagagagagggagagagagagagagagaattgtgtccaaagaccttgggagcacagctaagagcaatgatttgttcccggaaagctgaggagagccgtagagtgggaatatagttggagcagaggcttacaggatgcacgttccccaggaagttgacaggtaggggattagctgaggtagggtgtgcccagggaaacagtcagacatcggtgtgtggagagagacagccggagagaacctggagagggaaacttgtaggaagggtattggatactcacccagcgggcaatgaggtgcctcaaatagtgtgaacaaaggaaggtccctccatttcctgtgggccaagtgcaggacaggggtgtccatgacaagagagcttcgggatggagttttagctgaacttggaaagaaaggagaggagaagtacagaggccagagagaagagtgagtgcctgtggggtggcagggaaccgtgcgtgcggaagaactgtgcaggagcagcaactctcatggga

SEQ ID NO: 393853 - DNA, 403 bp, Homo sapiens
caggtgcatggatgcctggtggaatgaggaagggatgcagccaggtagagaaatgccctgccatcacttgcatcagcatctgtgaagagctggccaggcttttgctcacagtggttgacacagtcaaggagcaagggccccgtaggagaggggagtcaagggctccgggtgggaatggagctgggggctgatgctggcttctggagcactgtaatgtgactgagaaaggtgaaggagccgttctgaaaaagaagaaggcaggagctcgcacagctcttgactcatcttgacttctttttcctgcttcatccaagcaggtcgactctctcgtgatctcagagacagagtgaagtcatgagtgggaggggagcacagaaaataagaccttgattcccagcattgg

SEQ ID NO: 393854 - DNA, 621 bp, Homo sapiens
atataacacagtctaatagcagagctaataactgtcatagtttcaaaatagcagttgagtttaaggccaggcacagtggctcatacctgtaatcagagcacttagggaggctgaggcgggtggatcacttgaggtcaggagttcaagaccaacctgaccaacatggtaaaaccccgtctctactaaaaatacaaaattagccaggtgtgggggcatgtgcctgtaatcccagctacttgggagtctgaggcaggagaatcgcttgaacccgggaggtggaggttgcagtgagccgagatcgtgtcactgcactccagcctgggcaacaagagtgaaactccgtctcaaaaaaaaaaaaaaaaagaaaaagaaaaaatggcagtgagtttaaaccataccctgaattaatctgcaacaagtgtgatgtgatgggaaaaaaaatccatgtgatctctgttggtgtgaaattcaagggggttgttaatacctctgtaatttctactaacttcataatagaaggaaatgctaaatatcagaagttcatgaaaaaactggtttcctcccatccaagttcacaggatgaaccccagatccccatggccccagaataagagcccacac

SEQ ID NO: 393855 - DNA, 503 bp, Homo sapiens
ctagatcctgaatgtatcatatctgtttcacaatggattgctgctgtgctccattttccatgtcatctttcattaactctcccaattatcagttttattaaaagcataacatgggacaaatactcttgtagaaaatttatgcaagaagtttatgccagagaaaacacctagactgaacacttcatgtgagaactgcactgtaggatctggcaaattctgggcaatttcagcctgcaaagttcattcatttatcccacaaccactgacacttttccccttttcctaaatgaatgtgaaatcttggggcgcatgggcctctgtgtttgtcctcagcctggaacttcattcatatctagaatgtaaagttgccccagaatttgtcctttggttatatcaagccatggtttcttgtcctttcagatctgtgaaagccactggcttggccctggcttttgctagtcacccaaaggcacgaagttggttcaagagtcccaggacacctc

SEQ ID NO: 393856 - DNA, 127 bp, Homo sapiens
caaggccatgaaaaacccataattaaaatatcctcccatgaaaagatgctcagcatcactaaccattaaaaaatgcaaatcaaaaccataatgagatactacttctcacccattaggaaagcttatt

SEQ ID NO: 393857 - DNA, 563 bp, Homo sapiens
tgctgggattacaggcatgagccaccgtgccgggctgacagtggtttttaaagggggagggcagatgaaggacgttggtggaccatcctctgggaggagatgtggactgaggaagcaacgctgacctcaggccccacaccaccctttcacctcagcctcactttctcatcagtaaatggaactcattcttgtgtatgtgccatggaggcaatgtagcagaagagaatagggcagactttggaactcagccatctgggagaaaatcctagttatgtgatgaccttgagccaatgactgaatttctctgtctcattttctcttctgtaaaatggggacaattacagtgaattctgtgaattcattcatgtccctgacacatggtgtgagctcagtcattacctttgccagggttgcaaggatgtaatgagatggcagatgtgagcacagctcccagacccgaaggtgctgtatgaatgggagggagcagtgagtgttatttgggaaatattgaagacacaacttccctcccacatttgtctggggtggagcaacagttttactta

SEQ ID NO: 393858 - DNA, 656 bp, Homo sapiens
caatggtggagcaggagagagagagaagggggaggtgccacacacttttaaacaaccagatctcatgagaacaatctcactgtcacaagaacagcatgggaaaaccaccccaatgatccaggtacctcctgccaggtccctccctcaacacgtggggattacaatttgacatgtggtttgggtggggacacagagccaaaccatatcaatggttaagaattataaggtatgatatggcttcccaattgtcaaagaattaaaatgctcattaggagaggagtgactgcttctccctttagtagaaaaacaattcaaactcaggttaccaattacaatacacaaactaaaacagttatgttgagccgggaaaccgtcttcttgtaggctatcttctagcaccaaataatgcccacatgatttctggctgaaggccatcagaatggaattttagcactggaagaatagagttaatgttacttcttaaggagaaacctattacctttgtacattcattgaaaatttaggaagcataaattacatatttctgaacatactgttttgtaagtttttttaaaactttgttgatattcattgacccacacaaaatagattaatgaagaaatagtttgctgacccataccatgtcttcattattg

SEQ ID NO: 393859 - DNA, 310 bp, Homo sapiens
catggaatggctgtcagtataattgattgatgatggattagaatgctgaaaccttgagggtcaaggattacgtattgtgagctgggactctcttggatttgcttcagggaatgggtgtcattgttaccaaaagcctccttgtaagaaggggcaagctcattggcttatctgcactgagtggttttttttgtttttttttttttgttttctttgagagacagagtgtaattctgtcactcaggttggaatgcagtggcgcaatctcggctcactgcaacctctgcctcccaggctcaagcaattctcaacc

SEQ ID NO: 393860 - DNA, 389 bp, Homo sapiens
tcccaacggcagaaggaaaacaacagatactactgctctatcaatcccctctgagctcagatctaaactgtcccaggcagctaagcccaaggttttctgaagacatagtcctcattcgaccttctctgaacaagcttttcattctttcacagccgatagtgtcctatgtacccactacggcaacatggacatcagactttcttaaattaaacaataagactaaacaaaactaaaatgacttctacagttccaggctcacaggcagatgaggcattctagcaaaactagaaaagtcccggagggtccctgcacaaagctgcagttggagcagactgaacttccagaaaaagcactactgtgactggcagaggtcagaaaagcaaagcctg

SEQ ID NO: 393861 - DNA, 148 bp, Homo sapiens
agccaacctttccagtctcatcccttccctgacaacttacatagatccactctgcccagctcatcctttatatcaagtcatggcatgggcacagacaccaatcattttatagaaataggcctgggacaggtgtgtggtttcaggaaca

SEQ ID NO: 393862 - DNA, 360 bp, Homo sapiens
tcccctggatacgctcgggttacacaaacacaaaaagaacttggaggtgaggggataggcagggaaaataaaaagaacttcaaatagtcctgttatatttgtgccaggtgcggtggctcatgcccgttatcccagcacttaggtcttaaaaattcagtatgctggcacatccaatgtacttaacatacacatcaatcacacagatgtagaaactgggtataataccaagttacatgtgggaagacggtgacacagaggtcacacagccaccgccataactatggctacatgacaacctaacttcccatcatggaggacctgggcatatttactgagccagccttaacacgtggctagtga

SEQ ID NO: 393863 - DNA, 594 bp, Homo sapiens
tatgtcctatagacagtaagtagcaaaatcaggacttggggcttcaggcacagaagagtacatggaaagaacatggactgtggggttaagtaacttaggttcagtgtcttgttctgctgctgtgtaacatcaaagtgttgatttagcgtctataatggggggtattgaccatgtccatcagattactgtaaagattaaatgaggaacctgacacatagttggcactcagtaagttcatttggtcaatgtctatccagactgtgctgggtcctgaggatgcggtgatgacaaagataacaaagtcccctgccctagggggacttgccttgtcattggggagacagaggacaaataaacaaatcattacagatggtgcctaggaaggctaggaaggtaatgaagagcatgctagaataaattcatataaggaaacgactgcacacaggagatctagtaaggcctctctgagaaggtgatattgaagctgaaagatgagatgaagccaaccaggaggagaactgggaatcgtgtccaggataaaggacagccagtgcaaaggtgctggggtagagaagagcttggcagactccagga

SEQ ID NO: 393864 - DNA, 432 bp, Homo sapiens
tccttccccatctgcttatcttctaccttattcctagttctctaacaccgatacacattgatctatattctttaaacagatttttcttttcttcatcatctctttaaccagatttattgaattatttcaattcattgctagtgcatatagtttggcagccctgttaagtcctttgtagaaaaaggcaggttatgaataaatgaaaaagaaacataaaacatatagacaattcagatctcctaaattatctcaaatatctcattcattcattcattcattcattcaacaagctcgtgtctactggacacatgccctcagttctgtctattctattccgtaattcagaaagcagctttgagaaaagcatgcaggaaaatgccaggataacagggccaagttgactcatgctcttctctcatgaaggccaagtaa

SEQ ID NO: 393865 - DNA, 226 bp, Homo sapiens
ggcaacagaaccagaccctgtctaaaaaaaaaaaaaaatttccacaatgttctgcagtgcctatgtgtatatgagtctgtttctggggttccttattcaggtacactggtatgtttttctattgcaccaataacattatctagtaccatagctttaaaagagatcttgatgaatgcaaaataaatcctcccactctagttttctttggcaagagtgtctgggctat

SEQ ID NO: 393866 - DNA, 209 bp, Homo sapiens
caagcccttccgcagccccgcgcagccagacgacggcatcgacgaggcggaggccagcaacctgctcttcgacgagcccattcccaggaaaagaaagaattccatgaaggtgatgttcaaatgcctctggaaaaactgtgggaaggtgctgagcactgcagcaggtatccagaaacacatccgaaccatccatctggggtaaggcagct

SEQ ID NO: 393867 - DNA, 174 bp, Homo sapiens
ctcaagcagttctcctgtctcagctccccaaagtgctaggattaaggcctcttatcctttaaaaccataatgcctggctttatgcacaattgtgtccgattcacaattttccacagcatggaaagcagctgtaactgtgtttatattccgtcacccaaacttcttattctacct

SEQ ID NO: 393868 - DNA, 228 bp, Homo sapiens
tgaattttgttgggattagagaaaatgttttgagatggggcgagaattgtcttaaaaagtaaatagagttgcaataagtggtcgttttcctctggaaggaaaagtgttaataataggaacccctatgaaatgtattggattggcctcattaactattttttcccccaagggctcaagataagaaagtaccacgggaaatctccaaattggtacacaaatctaaattat

SEQ ID NO: 393869 - DNA, 735 bp, Homo sapiens
ctccagcttttccccaggccccttcttggccctcctcaccctcctgggctcagtcccaggatcagcctcctgcacagggtgggaataaatcctgtaggcagcctctgcccttgacagtggaagtcagggctgcctagcagggtctaattcattatttctcacactcagctgggggttagggcgggttgcttgagattcttgttaaacattcttggtccaccccgggtccctgaattccagtcagcaggaaccaaggaattaacatttgtgaccatcaaatcatccaaagggactccctttattggcagtttgaggaaaccatgggccagaggttggactctgaagttagacaaacctggctcacgtcctgcccctgatttgtcacatactgtgcagcctgggtgacttaacctctctgagcctcagcttccttatccgcaaaacatggaaatgttaataacagagcctgctttgtagagttactgtgggaaggaaaagaaaataatgattttacatcagtgtccaacatattcattcagcgcatagtcttgagcacctactatgagccagatgctaggctaggtcataggagtagagggtgagtaaggcaggtcccatttctgttcttacagttcaccttctaccagtaggggtatgagttggtaaatcaccttatttaccttacagtgaggcgattgagaatgggaggggttctgtaggccaagagagctctct

SEQ ID NO: 393870 - DNA, 202 bp, Homo sapiens
ctgagattgcaccactgcactctagcctgggcaatagagtgagactctgtcccaaaaccaaacaaaaaaaaaagtcagcattagggagactccctattttaggatgatccaagcagacacaggaaatcataggggagatacttaattttttttctttctcccagtctccctttttttcccagtgattgtgacgaagcaggtg

SEQ ID NO: 393871 - DNA, 453 bp, Homo sapiens
tgcttgtggaaggcctctctgaggtgatacttaaaaagagatatgaaggaaacggagaaagccaagcagaaaaggggtgctagggtaaggaaatggctgcgcccagtctctgagatgagtcttacctttttgaggaacagcaagaaatcccagtgaaccagagaaagaggtgggaaatgaggtaggcgaggtgaggtcatgcaagccagggggaaaatacctggatttattccagctctgaggaggccagaggaggattttaagcagagatgtgacatgatcagatttacatttttaagggatcactctggataatttgtgcagaggtatgagtcaaagcaagaaaaccaggtcaaaggctattgctaacagtcaacatgagccatgattgttatttccattaacagtatcactgaaatggtctgcaatctgaaataaagcctgaagaaacct

SEQ ID NO: 393872 - DNA, 434 bp, Homo sapiens
aggatccccggagggccgacggcaacaggtcacggcgcaagcagaggggtccagaagggagaggtcgggaggacgccccaaccggccgggctgctcccagagtggcacagtgaggggcaggcacccagtgccgtccaggactcaagatggggatggagatggcgtgagacttggaaaggacagggcaggtgagctcaggggaggaatgttacaataaacatgggaatagcttaagttggagaaatgtctgatgcctctttgagggtcatatctagcaggccgattcataggaaggttcactcccagtagactgcattaagtcatctgctcagattctctcttgtccattctatactcagaaagcagagatattccttaaagtgagattttcctatcttttataggtaggtattgatttttttctttacctttgt

SEQ ID NO: 393873 - DNA, 377 bp, Homo sapiens
gttcattgaaattctctagcctgaattagaagatgatcttatagataactacaagattcttcttggcattcatccaggttccaatctgatcctgttccctggagcagagctgagtggagcctcccaggatggctttgagggtgctcctggtggaaagccatcttaaacacactgctgcaaacagtgctattagccacaatagccacaatgctgcccccgttccagggtaaaagcattcagaagaaaatctggatactcagtactttcatcttgaaagagagtagttgctttcagcctaggtgcattcactatggaatagagtgagataaaggattctgcaggcaaatggaaggagagggccctgctgggtccctaga

SEQ ID NO: 393874 - DNA, 779 bp, Homo sapiens
tgtatgctataaaagaatacctgaggctgggtaattgtaaagaaaggaggtttatttggcttataattctgcaggctgaaacactgggtatctggtgaaagccttggactactttcattcatggaggaaggcaaaagggagctggcatatgcagagctcacaggtgcccagagatgctctccgcagcacactgctgctgcttgggaggtgtaggtggtgtcagcaattcagaaatgttttatctatttcttcagtgcttctttcagctatatgaagttaaaaacagccacttcgcttcttgaagacttcgctgcttagaaaatttttccaccagatgccctaggtcatcacttttaaggttggtcttccacagagccctcagtggatcacaattcagctcatcactttgctaactctaatcctttggtgccttgagacctattgtggtgaagtccgttctaaagtaacgactacagactgaatctattcacttcaagggtgattttccctggtggaaagaggcagaagagaaggcaagatcaccttcaggaacaagcaatttaagtactataatggagatgggtcttacagaagctatattggtgaaaggaataatattctctgagtaatctccagttaaattgtataatgagaatatttagtcctgaatatctaggtatataaatattcaggatacagattttggtccgaaatggaatacccttttacggaaggaacatgaaatgtcttaaaaaaaaaaaatagaaaatactaagaat

SEQ ID NO: 393875 - DNA, 296 bp, Homo sapiens
gtagagacggcgtttcaccattttgcccagaatggtctcaattcctgagctcaagcgatcctcccaccttggcctcccaaagttctaggattacaggcatcagacactgcacctggcctggatttctcaacatagttttaatggtagtttttaggtttcaatgtcttattcatgttgtttattcacaatacatttatgaatatatattttttctgaaatttttttaccttgtctcacttgttttaagtcttgaccactttaaaaaaatctttctttggatggattcagtataatag

SEQ ID NO: 393876 - DNA, 422 bp, Homo sapiens
atgatttgaaacgagttacaagtgctgagtctcagttttttccatcttcattggtgagctaatattacatactcagaaggtatgctaaggattaaatcatgcctagtttgatttaaagcacattgtggatgtcaagagaatttatcctgctttccttccatccatctaccctggctcttactgatagatatgaagaaagtccacatcacccttacacttgggctcttggtaggataagaaaaaatcatccacagtatgtagtgacttttttaggggaggtgtcaacacagaaaattgtagaactgctctgatactataaatatgtaagaacttcatttatgtgaaagccacttctcttccctactagtcactcacccagccttgctacttctaccatatacatatcattgctgcactttttt

SEQ ID NO: 393877 - DNA, 301 bp, Homo sapiens
gaaactgtaggtcactttgggtaatatggaccttttaaaaatattaattcttccagtctataaacatgggatatcttttcatttgtcatcaatgttttatagttttcagtgtagagatctttcactttattggttaaatgtagtcctaaatattttgattttttgatgctattataaataggattgttttcttatttctttttcagacactttgctgttagtgtgtagacataccactgatttttgtaagttgatttatgtatcctgtaactttactgaatttgtttttcagttctagtag

SEQ ID NO: 393878 - DNA, 226 bp, Homo sapiens
caagagctgcccttgttcctcccttgacactttcctaagtgtccctccttgtgctgttccctgtttgtttacactgactgaatattcttcagggaccttggttcccagtgtctcatcctctatctgattggaacagactagacatcacctctgtcccaaagcagagtattcctggcaatttctagctcactggcattctcatcaatctccttgtcaggggagaaga

SEQ ID NO: 393879 - DNA, 256 bp, Homo sapiens
tttacatggaaaagaataattgcaaggagagcaaaaagacactctgaaaaacactgagtggataaaataatgagtgggaaaaataaagcgaagagttatccttaaccactctaattaaaattaaaaataataaaataaacagaaagaaaaagagcattccagaaacaggtacaacagactgagatggaaaagtttatcacagtaaagaaagtgagataaagactgaaataaactatgatccatctgaagtataacg

SEQ ID NO: 393880 - DNA, 592 bp, Homo sapiens
tgattctcctgcctcagcctcccgagtagctgggattacagacgtctgctaccgtgcctggctaagttttgtatttttagtagagatgggatttcaccatcttggccaggctggtctcgaactcctgacctcgtgatccaccctcctcggcctcccaaagtgctgggattacaggcttgagccatcgtgtctggccctttgtgaacttttaatgaaaacagtcactgttttaaattccaacttttgtggaatttattggttgaactttgtgacaaactctcttgaaatttatccagagaaaaattactgagttgctagctcagttttatttattgtcagtatggttatattcttccctcagatttctgattgatactcttatttttcattaacttttcagtcacggaagataattacacagaaagaattgttactcatggatttttgcactcaattcacattatcctagccattttgtggttttcgtttccgttttgggggacacatttgtgaagtatttaaatgagatgacacattcgggaatactgaatccctaatagtggggtaccaagtggttgaagttggtaatgta

SEQ ID NO: 393881 - DNA, 187 bp, Homo sapiens
ggaggtggaggttgcagttagccgagattgcaccactgcactctagcctgagcaacagagagatactccgttcccgccgccgccacccccctccccccgccaaaaaaaagaaaggagggatggagggagggaaacttctttaccagtaaatgatggaagacaggaaaaacaaaagtccataacacat

SEQ ID NO: 393882 - DNA, 596 bp, Homo sapiens
tattaaattctttgcagtaatttttttaaaagctgcttcccgatgttgtgagggtcaattcagttaaaactgaataattcctaagtctacctaactggggaaacataaaccacagtgaatcatggtgtgctgtaagtaaaacccattgtttgtgggacttccactctttccctgggtttctgtatgaatccttacattaatcttagtaaaacttattttttaaaactaaacaaatctattcttccttcaccccaaaggatcatcttggagaagcttatatttagactttcgggaagagcttgacatttaaacaagtctcatacatttggcaaatataacaggtacttacaaaggtttttaggaacagcaaaggaagaattcatatcctacttgtggttctgtcactaactgtatgtctttggacaagttacttctgtgaacctcagctctcatccataaaatggtctgcaggatggatagttcacaatgagcgaattttgttgtaggcagagagaacacttacccagttatctagagcgtgagtgtatgtgaggagagatgggaagggaggctagagctaggttttgaaaggattt

SEQ ID NO: 393883 - DNA, 305 bp, Homo sapiens
ctcctgcctcagcctcctgagtagctgggattacaggcgcccaccaccaagtctggctaatttttgtgtttttagtagagatggggtttcaccttgttggccaggctggtctcgaactccttacctcaggtgatccacccacctcggcctcccaaagtgctaggattataggcttgagccaccgcacctggcccttcagagacctttggagccagaggtgacatatcgatctacatttaaccctctgggaaccaaggaatgaaggattagaggaaacggggccagaagtggagagaaggggagtg

SEQ ID NO: 393884 - DNA, 143 bp, Homo sapiens
cctcccaagtagctgggactacagtgcaagccaccacacctggctaatttttaaattttttgtagagatgggggtctcactatcttgcccaagcaccaaagcctgtatttttgaccccaacattgaatgaggatgggatctgg

SEQ ID NO: 393885 - DNA, 461 bp, Homo sapiens
ctggaggcatatgcagaggtgggactggggaccaggtctccaaagaccaagaatcagccgaggcactaaggggcagattgcagaggtgaacagtcccgccagtgagaacccggccctgttattccacggccttctctgccttctgcgagaaaacgaatttcccagaccccagcgcaggcctttctcacatctcagcagcagggaccgtggctccaactgcggctcaggatgaaggccccaggcgctgaagagagtgaagccgaacccctcctcaatcccaaaacactggggaccacggtgagacagcgacgccctggatgctgcctggtcaaggtcaggctgtgatcggcctgtcaggcgtgtggcagaaccagcttcagaggcagcggtgtccacgtaatgagctcaaatgatgccccaggaagaacatagatggcttctttctttaattcctcagcatg

SEQ ID NO: 393886 - DNA, 368 bp, Homo sapiens
tacaaatgatggatcaatgaccaccgtgggagagtgatgttcttagggaacatgtgagagagccagccaatgaaatgtataatgcaaaattaaggatgctggtccttgttcacctcattaaccatctaaactcttagtatgtgtgaggcatgttgtggtatgtgacagcatttaattcatccattcattaattccttttccattcagtgtttgtggtctgtccataggtgttgggaatatggggcaaataagacaaatagttccaggtctggtggcgcttacagcctgggaggagctacacaatgaaacaattacaagagcatttgatttgacgagcctgcagcctgggctgtggagttgaaggtggc

SEQ ID NO: 393887 - DNA, 411 bp, Homo sapiens
tttgagtcctccttcagccactgactcactagaggattaggcaagtcactcccactcactgacaatatctgccctgcctacgtctcagggcagtggagagggacacgtggaaaacgcgtaccaaaggcatactccacctggaaacaagcacaggcagattttcatcaacagaagcccttcacacccttctttcttcatcacccaaaacacagcgtaatttgccttagaggcataaccaatgggcatttcaggatgtccctgtcctaaatctccccagcaactcccgaaacggctctaacagaaacagtcttgccttctcttccctgctgtgtcagtatgtgaaggctgagaggatcacacaaggaagctgccacctccccagccacgtttgggaactacggtgctagaaca

SEQ ID NO: 393888 - DNA, 251 bp, Homo sapiens
caggcaccgttgaaggctgtcaacagtgactgaacaaggcaagaaatgtccgtgtcctcattgagtttatgttacagtgggtaagatagacaaataagtaaacaagtaagtaatatactaccacatctcttaagcaatgtgttggttaaatgaactcaccaactattccccaaacaagactgtatccttctgcctggctgttctttccacacagaggactacctgttccatcttcacatattaaaatccta

SEQ ID NO: 393889 - DNA, 244 bp, Homo sapiens
acaggcatgagccaccgcgcccggccgggaagttaatttttagtttttaaaagttctatggtatttattgaagtttatgtattatgactataacagcaaaaaatgcacattacatttctttaaaatgctagattgagtatcatttaaaaaaagagaagggatacttaatactatcatactaagggggaaagagattggaaagaagaggactcagtagaaaacaaagatgtgaagtaggaggaag

SEQ ID NO: 393890 - DNA, 638 bp, Homo sapiens
gagttcacgccgttctcctgcctcagcctccctagtagctgggactacaggcgcccgcctccatgcccggctaatttttttgtatttttagtagagacggggtttcaccgtgttagccaggataatattttgtttgaaatctaatcagcttgctaaagactggcatttgatagattgcctaataaatcttagaaacaatatctacatatgcatggaaggggctatataaggatatacatatgaaagaagatactagtctgcttcatcagataaaatatgataataatattggttaaataagtttgaatacattatgataatggtaattacataataattaacatttatttggaataatcagtatgctaattgcttcatatgcatcattacacttaatacctgtagcaaacctacaagatacttagtattctattcacagtttaataacagcatggcacagcttagagaagttaaactactggtacagagccttacttaaatgaaagaatggactgtggattcaatttcaagattgcttaatttcaatgttcatgttcttaactactacatgaggctggagaaataaggacaaaattcaaaactaagtaaaacagttttaaactaacaatcgtggaagg

SEQ ID NO: 393891 - DNA, 511 bp, Homo sapiens
ttggttgaataagggggtgctctgtggatctcaggggggctctgctccccatatgactggaaccctgtctccaagggctgcatcctatcgggttattgagggtgactgagaaggaccccctcacaagccagtcctcctaactctgcccctggatccccagagtttgccagggataggtgcctatccaccgacaacttactgcatgctccacagcctgtttaatcctaacaggtattagtatcccatctgacagataagaaaagtgagactcaggctaaacacagcggctgccacccaggaagcactcagtgagtgtcacatggctatttagaaacgcagttgtgtggccaggcatggtgatgcgtgcctgcaatcccagctactcaggaggctgaggcaggagaatcacttcaatctgagaggcagaggttgctgtgagccaagatcgcgccactgcattccaacctgggagacacagtgagactccatctcaaagaaaaaaaaaaaaaaa

SEQ ID NO: 393892 - DNA, 305 bp, Homo sapiens
ccaggtagacctaaccaggttaaggtcggcaaacgaatgatcctgtgtcaaatgcaccacgggagtgagggtttccactgcattcatgtgtgtgttccatgtcatgttttctttgactaaggccccactcaccaccacaattttccatcctcatgcaaacgggaagcagacacatggggatttggattgttaggtctacctggaggtagacctaacccaggtgtgagccactgcatccggccatgtactttagtttctaatttcttgggaaggatttgtaagaaggtgaattcatacaatggtta

SEQ ID NO: 393893 - DNA, 280 bp, Homo sapiens
cttcagctgattggaagtaaatgatgacaagaccctaggggataaaagattcacgaaagagaaggaacctgaatccctgaatcaccgtatggaagaaaactgccagccaaccagaaaaatctatcatggactgtcatagaataaagcctaaaattaaggctgaatattacgtgctgctttgacatctggtaaacttggagaacctcgaatgacctagttgcaagctttccttctcactctgctcctgtggataaggtgccatagccaagcaaccgtcctt

SEQ ID NO: 393894 - DNA, 425 bp, Homo sapiens
aaggtatcagtcccttcgcttctcgtttcctgcacccctgcagtgttgcatcctttgggaatgagtagatcaaagtaagagttatgtctactctctaccagcccaggtgctaacgttcacatacattctttcgtggaatccctgtgtgacctcagagatgaggttcagaacagttaagggcctgcccaagacctcagggaagctgggatatgaacgcaggtctttccagctcccagcccactctttccactctgttaggcagttttcaccctaccagcctgctgacacagcatgagacgcttcatccagcttcatcctatttccaacactgcttgaaatcctctccagggctcactctgcccataggttaaaaggacagcctttctgccaggcacagtggctcacgcctgtaatcctagcacttc

SEQ ID NO: 393895 - DNA, 594 bp, Homo sapiens
aaatctgaaaggtatcatcatatagtttaagggacaagagacccaaacgaagagatgtctttgctttcatttctggccactggtttgtgtaagaaatttaactgaaaagctatcttgaacttttttgaggatatggaatatcgctgtatcacatcacactggcctggaaacgaaagcaaattggatccatgtatggtaggtacccagtcataggttctggtgtcctgggaccactctagtggcagcaggcggctcccatgggagaatgagtcccggctatgggcctaagcattttccaactgtgcactgttggaagcttagaagcttagatcagcaaaagctgatttctcactcatacttcatgtctatcatgagttagcagggaggttctgttcatggtgtcacaggaaaagagagctgtggatggtcttgcattgacaatacatatatatcactttcagtcacaacacagtagagagaactagtcatatgattctgacagatcatagggacaaggaggcgcaatccgattaagtgcccagaatgggcgagaactggcaaagtgtactgacttaacacactatttaataaaat

SEQ ID NO: 393896 - DNA, 501 bp, Homo sapiens
agatttagcccttcatttttgcaaaacctctgcccatgtggtgataactgtcaataaactccttattctagaagcagatctaagaagtgaggtacaagccacaatttattgccctgtttagcccaataaacaaagaaccttgtcttctaaaaaaaaaaaaaaaaaaaaaaaaaaaaaaaaaaagagtcgtccagccacaagattccgaacctccccaattgctcctagggataacatcactattgcaaaacctaagattggtgcttaaggtgttttctaggccctgcattctcatgcaccaactggcactacccagaccagtaatctggctcaaccagttctccaatgccacctaggaacacaaggcagcaagaagaacccacttcaaacccctatgatttttatctccaaaccaaccaattagcactccccactccctggtcccctccctgccaaattatccttaaaaaccacagtctccaaattttcagggagactgat

SEQ ID NO: 393897 - DNA, 731 bp, Homo sapiens
agaacctgaaattaagggaatccgtgctctggacatgattccataggaatttagaaatatattctattatgtccaacaccaaatctaacacaaggaagccttcgggtcaatcagtctttctttcatgcagtcaatagcctttgttaaacaccttctaaaggctgggcattattctagaaacagagaaagagggaaagacaaaatgaacaaaagcacttgacaccatgaagctaagtatggagacgacagatcttaacaaatgagtacagatcattaatgaagtacctgcaaataggaaaatgcctcaaaggtaaaagaggcttggaaaccacaagccatcaataagttactcagcagattactacaagccactgtatctcaaaaaaaaaacaaaaaaaaaaaaagaaaaaaaaaaaaaaaaaaaaaaaaaaaaagaaaaaaaaaaagaaacaaaaaacaaaacaaaaaaaagcagaaaagagaaagaaagaaaaaagagaagcaacaaaacagagaagaaagaacgacagaaacaaacaaaaaacaggaaccagcaaaagaaagaagaaacagggggagggagctgacaaggctgcggaagagcggacgcggcgcggaggcgcgagagaagaaacgagacgcgaacgcgacgcggacgtcggtcggtcgcgagagcggccggggaaggaggcaaggagcgaagcgagacaagcacgcgagaaaaggaaaga

SEQ ID NO: 393898 - DNA, 336 bp, Homo sapiens
aggaatgaggggtgttaggtaggcaggtgacatgaacaagtctgcatgttagcaagacctttatcagtagggtatacggaatgaactggaagacagcagatgctaatgccagagcatgttaggagcctactgcaacagtgtgctaagacagcaggagagtatgaactatgggaaaagaagtagggacagatggaggtatttattaagcagaattgttaggccatgaaaattgattagttataaggggtgaggtaatggagggatcctgtttcagtattctgcatatggctagccagttttcccaacacccatttattaaatgggaatcttttcccc

SEQ ID NO: 393899 - DNA, 651 bp, Homo sapiens
ggggcgctagagcgctccgggaggctaggggagctgaattctgcgtcttcctttaggctgcggcgagacaatccccagagccccgcggcccggcctcggggcagccatggactcgcaggaattgaagactttgattaattactattgtcaagagagatatttccatcatgtattactggttgccagtgaaggaattaagaggtatggaagtgatccagtcttcaggttttatcatgcctatggcacattaatggaaggtaaaactcaagaagctcttcgagaatttgaggctattaaaaataaacaagatgtatcactttgttctctacttgcactgatatatgcccataaaatgagtcctaatccaggtatgatatttaaatgcaatgcttaggacattttttcctattcagtttatttttatttttctcagttaccaagtcattcagtctgatcacactatattatgtattttctgtaggtacaatttatacatatgtttatcttcctgacaagggtgtaaattcatcaggcacaagaaatgtgtcttatactattttcgtgttccttatatcctctggcagaggtttcattagtacatagggatttttttagataaaagggaatgtatattagtaattgttacacaaa

SEQ ID NO: 393900 - DNA, 1241 bp, Homo sapiens
ggggcgctagagcgctccgggaggctaggggagctgaattctgcgtcttcctttaggctgcggcgagacaatccccagagccccgcggcccggcctcggggcagccatggactcgcaggaattgaagactttgattaattactattgtcaagagagatatttccatcatgtattactggttgccagtgaaggaattaagaggtatggaagtgatccagtcttcaggttttatcatgcctatggcacattaatggaaggtaaaactcaagaagctcttcgagaatttgaggctattaaaaataaacaagatgtatcactttgttctctacttgcactgatatatgcccataaaatgagtcctaatccagatagagaagctattctggaatcagatgccagagtgaaggaacaacgtaaaggagctggagagaaagccttataccatgcaggcttatttttatggcacattggtcgccatgataaagcaagggaatatattgacagaatgatcaaaatatcagatggtagtaaacagggacacgttttgaaagcatggcttgatattacaagaggaaaagagccttacactaaaaaagcactgaagtattttgaagagggactccaagatgggaatgatacttttgctctgctgggtaaggcacaatgccttgagatgcgccagaattattcaggtgccctggagactgtgaaccagataatcgtgaattttccgagcttccttcctgcttttgttaagaaaatgaaattacaactagccttgcaggattgggaccagacagttgagacagcacaaaggttgctgctccaagatagccaaaatgtggaagcactgagaatgcaggcactctactatgtgtgtagagagggggatatagagaaggcttccaccaagctggaaaacttgggaaatgcattggatgccatggaaccacagaatgctcaacttttctataacattacactcgccttcagcagaacttgtggacgtagtcaacttattcttcaaaaaattcaaacgttacttgagagagcttttagtttaaaccctcagcaatcagaatttgctacagaacttggataccaaatgattttacaaggaagagttaaagaggcactgaagtggtataagaccgccatgacacttgatgagactagtgtgtctgccctagttggatttatccaatgtcagttgatagaagggcaattacaggatgcagatc

SEQ ID NO: 393901 - DNA, 322 bp, Homo sapiens
atagtcaagaatttcctcaaatgttaaatgtcaaaataccatgtgacccagcaattctacgcctaggtaaattcccaagggaactgaaagcattatgtccacacaaatatttgtacgtgaatgtttacagcagcgttattaataataatcaaaaagtgaaaacaatcctaatgtccatcaactgaatcataaaaattacagcttctgatcccaaatcaccatcaacacttaacaaaaataatctttctccttaaaaacaagaagcaagcctgggcgcagtggctcatgcctgtactcccagcactttgggaggccgcggcag

SEQ ID NO: 393902 - DNA, 275 bp, Homo sapiens
ctctggggaagaggggattaagggattaaagtattaaggggcagcgtcaggtcttcccacagaacctccctgcccccagctaggccccaaggacccaagaatcagccaaaagaatgtaaggagatctcatcctgtttgcaatcccctttgtaacttgctcctggggaaaacaagacacaatgctagctccttcccaggcccctgaggcatgatcactcgtgttccgtgttccggggagagcttaagaaatcacagtggccagaagcccagcccag

SEQ ID NO: 393903 - DNA, 536 bp, Homo sapiens
cttccggctgctgcctttcaatgggcccactggcgtctcccctgctgcacaaaccaactagggatttgaacaaaatttctgttcagaggttgagatttgctccttcttcagttcccctctttccagaattcttctcctaactttcttaacttttgctctgctctgcccaccccatttctgtccttgacatctcaagccactgaagatgcagctttctgccacccctaaccttctgaagaatgaggactgccttcaggcaaaaggtgcaaacttgtacatcttgaagttctcttcttttaggggaagacgaccctccagtttatgcttttggttactcttcaggccttcaactagctttttgtttgtttaactttttgttcattcacacttcatgattgttaacctggagggaattagtctgaaaaaggaaaaaaaaaatccactattactagaaactagaattttactatagttactttgaaactccaaatcagtggttctcaaacttaactgaacactggaatcacctagaaagc

SEQ ID NO: 393904 - DNA, 402 bp, Homo sapiens
atgatgtgcaaaattggatgactctcctatctcgtgcttagatatgactcgtggcagaaaatatgaaatttgacattctggattcttgatttgtgacctgatcagtctcttaaagtattattccattacatttgtctattttagggtatatttgttaatttctgaatctgcctgaacatccctagagcaggaagggagagtagggagtccagcacctgctgattaagaattgctgtggatggctggtgcgaagatagtgagttattgcgattgtttggttacagatcaaatgccttgttctactttattcccccttactactgcacttgactagtctaaaaattatttatttatttatttttagactagtcaagtgcagtagtaagggggaataaagtagaa

SEQ ID NO: 393905 - DNA, 142 bp, Homo sapiens
tcctcaaattaatatgcataggaattatctgagtctcttgttaaaatgcactttctgacttagtaggtctcgtgtgagtttgagattctgcatttttagtaatctcccagggattgtcaagaccgctggcctacagcacatg

SEQ ID NO: 393906 - DNA, 315 bp, Homo sapiens
actcccccaccctttcccctgccggactggggctcttggccggagcggaaaccttgaagttcctgagttgcatcttggctgcgtctgacctgagagtcagaacccagggcccccaggtacggacgaactcatcctggggccagtgtaggcccccgttcccagcaacacagtccaaatcctgctcatctgggccctcgcgtttccctgttcagaagcacagttcctacttttgcagatggaaaaactgaggcccagatggtgcttagcacagtggctggcatgtagtaggtgctcaataaatatttgttgttgaat

SEQ ID NO: 393907 - DNA, 320 bp, Homo sapiens
aactctatgggtattccttttctgcttcttttatggtgaacacaacatttatagacttctgctcttctatgggcaaatattactcaaattatcatctacctgagagagtgtaaaatgaacattttgtattctataccagttttaccctaggttcaatatacttcaacacataatagcttccattctcatctgtcagcatatggtgttgatcatacggtgcacagtaagacagacacaaggtttccaaatgccatgaagtattttagaggcccgaattttacaaaataaaaagtcacattagagccctgttgctaggcaag

SEQ ID NO: 393908 - DNA, 589 bp, Homo sapiens
gcttttatagttggctttctaaaacttgtttgctacaagcctagacttaaaaaatcatgaaacccttcccaaagtttgctgatttttacaaaatcagacctcttgcctgctaacatttccagaccctgtctgattctcatcacatctcttctcttctactggatctatgaaaccccattgagtcctaatcgtactataacctacctcccagtacgacacttaacattctctttatctctgagtgtgctcatttgccaaaggcaggaaagtctataaattccaccctgcaagagcccctagtaaagacttctctatgcaggtctgattcatagaaagattcattttggttgcttaggaaatcaaagctccactaacaattatggtatcaaaaaaaaattacaccagtgactctccttaattgaaaataagacttcttctactaaaaatacccacaaattaagttattggtgtcataggtccagtacagaaagtcatttttctcctttactattgtggaagctttaaaacatggccacaaactctgacataccttccattgagaggtgaggtctatgtcccctctaccttg

SEQ ID NO: 393909 - DNA, 746 bp, Homo sapiens
agagaagatagcatatggtgttctaaaagttaatatgactatagaacccattttcctatggaggaaatttatcaaggaacatgactttggacgtgccgctttatgagaaaatatattaagcctttttgcactaacttttctactaagttgggcttttgtgctagaatttaggagatgctgaagatgttagttttattactgtctgattcatatgtataaatattatttacattgagtaattaagctgtattctaacagagaccagtgaactttctgttttactttttgttaaaacagacttctgattacaattaccagaattctaaagtatatctgtgcattttgaaatacagatgttaagatgctttaattagctctttatataattaatctaatgcttcctaatgaagaatagagtgacatcagaaatctcagatgtagaacagtcaccaaatcagtaataatatatttgatcctaaaatatggccgggtgctgtggctcgtgtctgtaatcccagcactttgggaggctgaggcgggcagatttcctgatctcaggagttcaagaccagcctgggcaacatggtaaaacccatctctacaaaaaatacaaaaattagctggacgtggtggtgcacacctgtagtcccagctacttagggggctgaggtgggaggattgcttgagcccaggctgtagggagctgtgttcgcgtcactgcgctccagtctgggtgacagagtgag

SEQ ID NO: 393910 - DNA, 323 bp, Homo sapiens
ccgcccggagaagatagctgactttcctaaggttgcacagggaaaggatgaagaactgcatagttaggatcaacatctgattcctggtccaggcttctgcccacaccttccctcccttccccacatcctggctgcctgaggcacagggctggtccagggaagaattgggagataacttagtgagtaatatcagcaagggacccggccctcccttcagtgccatccccttggggttctggcctccgacatttactgaggttctggcctctgacatttactgagccaggtactgttccgagcccctcaccatgccatctcattgg

SEQ ID NO: 393911 - DNA, 442 bp, Homo sapiens
aactccagagcctgggcctgaacagggaggtggtctctcaggcttgatgctcaggcctatatctctccatttttgccctatctcttaaatatatgtaatgtcataaaatgcttttgaatctttttaaaaagtgtcaagctcatgaaagacagcctaagaaactattacagattggaggaaactaaggaaaaataaaactgaatgcagtgtgtatcctagatcagagaaagaacattagtggagaaagaacattagtgaaatgtgaataatttgagctaataatattgtaccagtagccggatatggtggtgggtgcctataatcccagctacttggaaggctgaggcaggagaagctcttgaaccggggagataaaggttacagtgagccgagacctcaccattgcactccagcctggacaacaagagcaaaactccgtctc

SEQ ID NO: 393912 - DNA, 884 bp, Homo sapiens
  misc_feature (548)..(548): n is a, c, g, or t
ctggctcctggggggctcccagcttaaagttcagatactgtattaggtccgagacttgccctagtatctgggcgttttacacaaactctggttagacacttaaatgcattatctcttttaatcctaacaataacctttttattatttctcttacagatcaggaaattgaaggccagaagggtaaagtggtttgcccaaggccatggggctggtgtgtggctgagttgtggcttgagctaagggcttgtaagagttgacagtcagtattccgagagggagatgtaggtggagacaggagatgaagctgaaagatgagagacagtcagccagagagaatggaaggaaagaacaggaaagcagagagaggagtgtctgccagtcccaggataccacggctatatcagctttctattactacctaacaaatgatcacaaactttgatactcaaagtcacacacatttatcattttttagtttctgtacgtcagaagtcaaggacctctctcaatgccattggttccttggaccgtatcactggtccatctcntgagcccctcaatcctatcacagtttactgacttttcccattcagctgtgagtgtccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacct

SEQ ID NO: 393913 - DNA, 282 bp, Homo sapiens
catgagatcaatgcacagggcagactctcgcctaccaattacaccagttaagcctcctgtgagcacagtaatgacaaggacaaatgcaattgttttggtaggcaataaacctcacgttccagaaccctaaatagctactaggtttatttgtcctaaaggcaggtccctgattttccaagtcagtgcttataactaaagcttagggttttttttgttggtttgtttttttgagatggagtctcactctgtcgcccaggctggagtgcagtggcacgatctcgg

SEQ ID NO: 393914 - DNA, 418 bp, Homo sapiens
acctttactcaggtaaaagaccaatcactcatcaattgccaaaacgccttgacagtttaaggtctcaatcctcagagtcagcaaagctgaagtgtctatgtccttttaaaaggagtctgcatctctactttagaaaccatcttctcactgcgcttggtggcttacgcctgtgatcccagcactttgggaggccgaggcaggcggatcacctgggtcgaaaccagcctgaccaaaatggcgaaaccccatctctactaaaaatacaaaaactagccgggcatggtggtgggtgcctgtaatcgcaactacctggaggctgaggcaggagaaccgctcgaacccgggaggtggaggttgcaatgagccgagattgcgctactgcactccagcctgggcgacagaacaagactctgtgtca

SEQ ID NO: 393915 - DNA, 328 bp, Homo sapiens
ctcttttgggttgtagattgctgttgtctctttgtattctcatgtggtggaaggaggctgagagagctgtgtccagtcttttttatgaggacactaatcccattcaagagtattccactctcatgacctaaattaccccctaaaggccctacctccttataccataacattgggggttaggattttaacatatgaattttgtgggagctgggagggtaaacattcattctgtagcaattccctcatagcacttaccacagagattatatttatttatttattggattatctgtttctttacccccactacactataaaccctatggtg

SEQ ID NO: 393916 - DNA, 299 bp, Homo sapiens
gtccctgcaagggtagggaaagcgtgtcatgggatggccctccactttctccctctttgcagctagctcctcaaggattctctttctgaagttaaccaggctcctctggagcagtggtcatagccctagggagagcccagggcctggcacacagtgcacagtaagcctttgctaggagttgttgatgagcaaaccagcttggtagccacaggaagatgctctaagagaagcagggtaaatgaaccctccccagcaaccaaacagagatgtgctgcaaaagacctgattactgaaaggtt

SEQ ID NO: 393917 - DNA, 204 bp, Homo sapiens
gtccttggacacatcagaatgctctaggcctaaattcttttttcttttcagtgaatatgttgtcctaggtaatccttagatctttttcagctctaatatcctgtgatttcacacttttagattgagaatgggcaaactttggaagactgtgtgcagtttatcttcataccactgacttcatttctgctgggagctaatatagag

SEQ ID NO: 393918 - DNA, 454 bp, Homo sapiens
tactaacaattcaattgcatggcagacccctctcttagcctagttacctggcaagttcttctcagtgaatacaatgtaagatttaacacaagccagaacttccttgctagagtctggatgctcgccctgacatatccacagtcctttctcaatcgtccacgtacagattatctgctgcaaatattttagtctcagggttgcttgccaagatgtttgagtccacaaccttctgacagcagctgttcgagggaatgcagatgaattttaatattagcctctgccaaatataattaggcgggtaaatctgctgccagtaaaaagagaaagatatcatatgtgcattccaggccaaatggtttcttgcagtatctgtatcaggctctccttagggaatgagggtcctagcgatcccacctctgtttgtaaacacagccacatactgtggtgggctgca

SEQ ID NO: 393919 - DNA, 766 bp, Homo sapiens
ggagtttaaggtgacacgtggagagcgcggcggacgtccttacctccagaggaagtggggattttgatagttcgggctgacctacgcgggttttggtatcaggatgatgctggcctcataaaatgagttagggagaagttcctccttttcagttgcttggaagagtttcagaagaaatggtaccaactcctctttgtacctctgatagaattcagctgtaaatctgtcaagtcctgggatttttttggtagcaagctggataaagaatcaagacccattggtgtgctgtattcaagagacccatctcatgtgcaaagacacacataggctcaaaataaaggaatggaggaaaatttaccaagaaaatggaaagcagaaaaaagcaggggttgcaattccagtttctgataaaatagactttaaaccaacaaagatcaaaaaaagataaggaagggcattacataatggtaaagggatcaattcaacatgaagagctaagtgtcctaaatatatattcatgcaatacaagagcaatcagatttataaaacaagttcttagagacctacaatgagacttagtctcccacacgatgataatggtagactttaacaccccactgtcaacattagatagatcattgagatggaaaattaacaaatatattcaggacttgaactcagctctggatcaagtggacctgatatatatctacagaactctccacctgaaaacaagagaatgtacattcttctcagcgccacatgg

SEQ ID NO: 393920 - DNA, 171 bp, Homo sapiens
ggagtttaaggtgacacgtggagagcgcggcggacgtccttacctccagaggaagtggggattttgatagttcgggctgacctacgcgggtaggacttcgagggcccaggagcgatttaaggattttagaatagttacccatactggctctgcaactcctcgatattcaag

SEQ ID NO: 393921 - DNA, 346 bp, Homo sapiens
ttttgaaatgggcacagaaatttctctcgcaaggagtctgacacctttttaagtctgattaaaaatcatttaccatctattctccctgaagcctgctacctggaggtttcatctgcatagtaagaaccttgggctccacaaccccttatattaacccagatactcctttctgtttattccagatctttagataataacttaactccttcaaccaattgacagtcaaaaagctctgaatctatgacccggaatcccttgcttcattgtcctacctttccaaactaaaccagtgtacaccttacatgtattgattgatgtctgcttataatttctgtgcccatttcaa

SEQ ID NO: 393922 - DNA, 559 bp, Homo sapiens
tctcttccctctcttttcttctttactcatttctttttaatttctgtttaatgcatataactatggacttccattaaagaagaaaagagcactttctgatagcaaaaggtgacagtatttttatatgcatcgagagtgaggttgttaacagcagtgtcactggaaatgctgccaatatttttcttgctggagtgtttctccaatatgagggtgagtaatcatagaattacattgaaaattctaatatttaaacaattaactggctagaaaagcaatttaagtttttcttcaacttccaaaatggcaatttagcactttggatacaaagctccaagctttactatttatgggatatgtctagttcatattcagtgcttccattgcaaattattgtgacttttaccaaatttggtattgaaatgggtatttatatggactcagacgtttgagagtatttcttttatttgcagttatggtgttcatgagcaaaaacaaataaaccaaatcatacaaaacattattattcacagtgattgaaaacaaaataatgatccagtaa

SEQ ID NO: 393923 - DNA, 461 bp, Homo sapiens
ctgaatatgtagctcactctcatatctcaggatcatcacttacggggtataacaactatgaaaagcctttatgtttgggcacatcttagtgactgatggagatcgaccttaatttagcccacaccggtctggtaggaccagaaccttcttcggggaccaaaaccagtggaattccatttctcatacagtttatgagttgtaaggaatctaattggtgaatagaggtaaaactacatgttttatttatttattttagaaatagggtcttactctgtcgcccatttcaaaaataaaaacaaaaataaaaagtggggcagggcacggtggctcacacctataatcctagcactttgggaggccgaggcaggagaatcacttgaacccgggaggcagaggttgtagtgagccgagatcgcaccattgcactccagcctgggcaacaagagtgaaactccaactga

SEQ ID NO: 393924 - DNA, 401 bp, Homo sapiens
tttctatctctatgtttttgtgtatattaaaatctatctaaatacaaggtttaaaagaggttaagtatcatttttcatttcttttgacccaataatcccacttttgggtgtcagtcctctagctcataaagacagatgagcaaggatgttaaatatagcactatttggactggaaaggaacataacttgaaaacagtctgacagctgtacttccattactaatggaattgttggataaattatagtgtgtccatacaatattatatagcaatcaaaaagaatggattgagttatatgctatattctggagggatgtccaagatgtatttttaggtgttgagtaatgcataaaatgtaatttcattttaataaaaagaagctatgaatattgcaaaaagctg

SEQ ID NO: 393925 - DNA, 406 bp, Homo sapiens
ctgtcctcctttccataaaaatctttttcagactttcttcacattacacttccagctgtatacacttattatctcacaaatagaaaatggtgaaggatccaaaaatcaaccacaattggccttggaggaaacctatatttaatgttctaggaaatcctgtgaaagtcaaaaggatctctccagtttccccatcacaattatctgcttaattcctctccattctactcttgaaatatggtttatctcttagactaatataaagcagagttacattaaatctcccttggagcagttagggcagttaagcatttaggtttcaaaggaatgcagccagtaagcaaaattaacatcaaaagagaaagccagatgtcaaaatactgagtaaaatggtgctgtcaataatgaa

SEQ ID NO: 393926 - DNA, 354 bp, Homo sapiens
tggagggagcctcttgagtccccagactcagtctgggcactgtctgcagctaacaatgtcaaaaggaggcatggggccagtgtggtggctcacgcctgtaatcccagcactttgggaggccgaggcgggtggatcacaaggtcaggagttcaagaccagcctggccaacatggtaaaaccccatctctactaaaaatacaaaaattagccgggtgtggtggtgcacacctgtaatcctagctactcaggaggcttaggcaggagaatcacttgaaccttggaggcgaaggttgcagtgagccgagattgtgccactgcactccagcctgggtgacagagcaagactctgtctca

SEQ ID NO: 393927 - DNA, 575 bp, Homo sapiens
atgagcaaaaattttagagacctccatcctggaaaacagtgttctggagaacagtgtgagtcttgtggcttgtgggagtacttttttatttacatgatttcaaattattgcattagctgctaaaaaaataaactagggcttctcaagttggatgagcatcaggatcacctgcagaagtctgttaaaatttgacggtctttgcacagccctagatctgctaaatcaattccagtatctccatgaaacccagcatccatgcaaacatgataagaagtgacttaaacccttagcagttaataagctagctactaattattgtctttacaaatttaacaaatataggtaggagtatttaggaagatttccagaacagaggaaagagatacagatagaaatgtagaaagaaaaggttatatttctagtagcatttttctagaacaatctctggcctttgtatttatctttatatataactttagactctgtactgtaaaaaattaacaccttatttcttttttgcccctatgctatggattttcaaatattggagaattagaaaatgctatgaattatcg

SEQ ID NO: 393928 - DNA, 386 bp, Homo sapiens
cagatggtagcaaacgctctcacctggcttggcaacacttcttcacctcttctttctaccaccacagcgactgtctccctccagcccatcctactgccaaattcatcttctattaagcatagcttcaatcacatcatttctttatcaaaacacttctacagaggagttccaaatgctttagccgggccgtccagggcctccacaggatgaccccagcccatctagttttctaccactctttatgtgtttcctaagtaccattcattattttaggacttggtatttgctgatgaatttacttacttacttgagagtgtggcaaaagcacatcctaaactttcagttaaaaggagtttgattgacctgctctgagtttaaggcacgtg

SEQ ID NO: 393929 - DNA, 571 bp, Homo sapiens
gaaatagacccatttgtagatagggctatcaatctgcagatgagcttcctccctgtccaaatttggaaaaacattcagggccatcaagatattagtattattgactctggcttcagaagatcaaaaactctctgaccaagaaggaaataattctgccccttcatctgctttgctaaacgaacaaagacaagcacttacaattcaatgccccacaaaggccttctgtgcatttattcctgcaaccaacatttattgagcatttaccctgcacaatgaagtctcattgttctttttttactgtacctatctagaaagaatctatcttcaaacttgtctcagaactaaaaacagcagacagttcaagtgtttctatttagctctaaggttttctatattttgggttagagacaagcagaccattcaccaaaagccttgcccatttaaaaatatgaccaatgactgtacatgggttccaacatgcaacacacaaatggaagttttaatgggcatctgtgagattgctggagataagaaaaggatacaggccaggcatgggggctcacacctgtaa

SEQ ID NO: 393930 - DNA, 629 bp, Homo sapiens
gtcaaattgtaatccccaatgctggaagaggggccttgtgggaggtgattagatcatgggggcagatttcttccttgctgttctcgtgatagtgagtgagttctcatgagatctggttgtttagaagtgtgtagctcttcccccttctgtctctctttctcctgctctggccaggtgcctgcttcctgttcaccttccaccatgattgtatgtttcctgaagcttccctagccatgcttcctgtactgcctgcagaaccatgagccaataaaataaaactttttttctttatatattacccagtctcaggtagctctttataacaatgtgaaaatggattaatacaggagtcagtagcaatagtctaaagaaatagttttaaaatagccaagagtgtactttactattcctatggaaagataagacagcaaaatatttgaaagactggagaacaggacattttagatactaaaacatgttataaagcgaaaatatttaaattactatggtactagcatgtaaatagcccaatgaaacacaatagaaatttcagtaaaagttgaaattgtgccatttaaatcaataagggaaaagatcaaatatgcagtgaatcatgttgagatgacagg

SEQ ID NO: 393931 - DNA, 490 bp, Homo sapiens
gatgctctttggttctccagttgtctttcaggaggtgtagcctggttgtggcctggggagtttggctgttctgtgtggtgtgcctccacggtgtggtctccagtgagctgctcagcaggtgtagacccgggcagggcgaagctctctgggctgttgactgtgaggcccctccccaccggtagatttccaagcctcttcagttttgcattcagccacagcagaatccgaatgaatactgagtgctaaagggagatttttaggttgaatgaaaaggatattgaatagaaacttggacttataagagtttcagaaatggagcctgccaggatgaattcttccagcttcattcttcatatgccttctctgcctcaagaaccagtgtcctgctggtcccagtccatccctgctgtcatcccaactcttccattaattggcagaggcagaatggggccctgaggtggtttaaataaaccatttgttcatttatcag

SEQ ID NO: 393932 - DNA, 431 bp, Homo sapiens
aggcagtgcaccgtgcctgcctgctggccgactcctagagtatccccaacgttatataagagcatataggccgctgtaaggaacttaaatttaattctaagaataatgggacatattccagggttttccacagaggagacacctgatttaatttacaatttgaaataggtaacactggttactgtgtgaagaatggactgtagagagtaaaagtgaaggagaaacagctaattatgaggctactgcagaaaaatttaagaatgtgccaggcagggtggctcagcctataatcccagcactttgggaggccgaggcgggtggatcacctgaggtcaggagtttgagaccagcctgaccaacatggtgaaaccttatctctactaaaaatacaaaattagcctgggtggtggcgcacgcgtgtaatcccagcc

SEQ ID NO: 393933 - DNA, 891 bp, Homo sapiens
gagaatgttagatattgataagacactgatggtgtaaagttatgagccaaatctatgtaaaaatgtaccagttaacaaaacctgtggctattatgaaaaacttacttgaataagactttctgcttttgtgttaatgtgtccagaacccacctgtagaagttctttgtgtatgcagtcttttcaccctacagtgctttcattctgatacacttaatcagagatagtagttttctgggttaaatctagtcgcttatcctcctggatatagcagaaagatagtgggatatataggtgtgttgtataacttttctcttttacaccttttcctttttttaataagaaaactgggattgaaatagaataagttgaagttaatggtaaaaattccaaacctggctgggcaccgtgactcatgcctgtacccagcacatgaggccaggagttgaagaccagcctgggcaagatgatgagacccccgtctctacaaaaaaaaaaaaaaggcaaataaattaaccaggcatggtggtgtgtgcctatagtcctagctacttgtgatgctgaggcagaaggatcccttgagcccaggagtttgaggctgcagtgagctgtaatcgcatcactgcactccagcctggatgagaccccgtctttaaaaaataaattaaaaaaaaaaaaaataaatcccaagccttttgctttcagcttccatcttaaaaaaaaaaactgttatgactaaaattaactaaaaaatgatttgggctccaaacccacttttaattttaaatactcttgattataagcccttaaaagctgtagtggttgaacctggtagttccagcagtccaaatacaagtacacagggttgtagagaactgataggctactaagctt

SEQ ID NO: 393934 - DNA, 287 bp, Homo sapiens
ggagctacatgaccaaagcaaaagtgaggcaggaaagtatttcaagcatttaggaataacctgctatttcacgagtccatgggaaatttcaaaagcacttcacaaagagctgttttcagtggagtctgttagtctggtgaatactggcatgctattattgacagcacccagaaaagcgtcttagaaacttaaacaagaatgtccaagggaaatatagataacagaagaccacattttaaagtaaaacttaagtgatgatgctgatattaaaccctaaaaatgagggt

SEQ ID NO: 393935 - DNA, 413 bp, Homo sapiens
cttgctgcttctgctccccacggattccctgtgggcaatgtttcctgacacactccacgcctgtgtcctggcctgccctgctccctgcctaggtctaaggcccagagtcctgctgattagcgcgaggctctaagcagccacccaggtggggtttgctgaccacctactgcgcgctctgtacttcctgccccactctgacccctcccccaactgtgggttataccaactctgactgcaggctgaaccccaaatcccagtttcaggttgtgccctaccctggggccaggcatctcagccagccttgctcttgctttggggagaaactggatgaggagaagaggtcctgtccctctagagaagcccccatcactgagggcgtgctgtgctcacaagaatctctatcacaaagacct

SEQ ID NO: 393936 - DNA, 172 bp, Homo sapiens
tctagagatcccgactaccacctgacgtacccacccccctgtgctaaagaataccacctgtatcagtttcacagtttcctaacactccaattgctaaaaatcatgcaccacagttggcaccatatctgggccctgaccatgttttacagccagctctctgtatccacaggtt

SEQ ID NO: 393937 - DNA, 296 bp, Homo sapiens
cagagcacactgtcatccagttgaattccagccgtccagcacatcccctgttgtcttctaaatacgccatatccctgctgattaagagtgttgccttcatttgtaacctctgaatggatttttgactttgcagctcactgacatcataccttttctacaaggcctcccttcttggttatgctcatagtacaggttgagcaatcctttcttttaactctggtgcttcctatgtctgatacatgttttcttacttaattgcataatgctttatagtcatttaacttctttagttcttg

SEQ ID NO: 393938 - DNA, 424 bp, Homo sapiens
atctctccattccccacacacctctagcctctggcaaccaccattctactgtctctttcagttccattgtttcagattccacattaagtgagattatgtgacatttctgtgcttagctttctgcgtttggcttatttcacttggcataatattctccaattccatccatgttgttgcaaatgacaaaatttcttttgtttttccactgtgtatatataccacattttctttatcaaatcagacccttcgggtgattccgtatcttggctattgtgaacaatgctgcaataaatatgagggtgcagaaatttcttcaataaactgatttcacatctttggggtaaatatctagaagtgagatgactggatctgaatactgtttttaaagtataccttttcccttaatacacactaatttgtttag

SEQ ID NO: 393939 - DNA, 1718 bp, Homo sapiens
  misc_feature (1)..(1): n is a, c, g, or t
  misc_feature (938)..(938): n is a, c, g, or t
ncaaaagatcgcagtggactgtgtgattgacctgacaagagctgagggagaaaatagacctattgccactcttgacttaactttagaacctgtcactccttcccagagggagccaaccagtcttcagacatgtgccagcctctctggcaaagcggtgatggaagggcaggtggacagaagctctcagcctacagcacggagactcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtagcagcagcagcagcaatcaaaaagtacccttgccatgcccacagcaagatgtgtctcgcccaccacaagccttgccttgcccactgagagcctcaccttgtccaccacgagccttgtcatgcccatcacaaaccatgcagtgcaaactaccagctctaactcacccacctcaagaagtgccatgccctcggcagaatatcccaagcccacctcaagactcgttatggcatcctcaacactcaccaagcccacctcaagactctctgggcctacctcaagatgtgccaggcccgcctcaaagcatattacatccacaagatgtggcatacctgcaagacatgccacagtcaccaggagatgtgccacggtcaccaggaaccatgccaccatcaccagatgtgccacagtcaacaggagacatgctagggtcaccaggagatgtgccacagtcaccaagttatgtttcaccgtcaccagatgcaccacagtcaccagggggcatgccacacttaccgggagatgtgttanattcacctggagacatgccacactcatcaggggacgtgacacactcacctagagacatccctcacttaccaggagacaggcctgactttacccagaatgatgtacagaaccgtgacatgcctatggatatctcagctgcgtcccctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgacctccggttcatcatctgttctttcagacgctaataccggataaagacacgagagaacaagggtcaaaaattagaacccatccctcatcgaagactaagaatggtaacaaataccattgaagagaattttcccctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacggctacatccagccaatgccaagacagtggagtgggactggaaactgctcacctatgtcatggaggaagaggtaacaacaattataagattatatcttctgtaggggaagttttaactataaagaaaagtgataccaggtgccatggcg

SEQ ID NO: 393940 - DNA, 279 bp, Homo sapiens
tgagagaagatggtgacatcctggaatagaaccaaagttagaggtcagaggagaaagggaatagggacataaatagtccctgaagtgagaaggcaacaggggagattggaaatgcagcagggtctaagaggtcccagagggtggctgaggatctacttctgaaagccctgcttgtcccccaggttgccccttttttgctggtcctggtgcttgtcaccagaaagaggcagattcctgaagggagccagctgggtcctcagcaaactgaatagcatggga

SEQ ID NO: 393941 - DNA, 265 bp, Homo sapiens
aggaagtgttgaattgaggtgggtgcagtgtggttaataagcacccaattctggctgtgctacttcctggctgagtggcctgccctctctgagcctcagtttccttatctgcaaagtgggtaataaatgacctatccctgagaggagatcatgggagaaaagagcataaatgttcacatctgatgacgtggatccgaagcccagctccaacacttatgagcaggtgtccctgagaacctcacctgcatttattgtgcctcagttt

SEQ ID NO: 393942 - DNA, 462 bp, Homo sapiens
agggattaatgccaaattgcatttctgccaaaaaggtatctattttcacaaatccattcagttttgcaaattaagagctttgggttttctgtgtattgattttgtcgggaggggaaaaaaaacccctctacaaacatcaaaggagaaaaaaacttcctgtagaaatcctttgggttaacagccaagttttaaatatacagcttgattctttgcttgtctggcagggaagggctcacctccatgtgcattttagccacctcccaataaacctgttgactgaaaagtactcactggaaaaaaccactctactaaagcctgctatttttctaatgggccttaaacccaagattcactgacagcaggcaattacatataagctctcattaagagaggaaaatatgatcacttttatactctcaaaataacaagtcaaaaaaaaaataaaatatttttgtctaaagt

SEQ ID NO: 393943 - DNA, 130 bp, Homo sapiens
accaaatggggttttgatctcctgcttctcaggaggtccggtgcccatttgcctactgcctccctccagaaacctggtggtttagtggttgacaactgacaaccacagactgcctctgggctgcagacat

SEQ ID NO: 393944 - DNA, 376 bp, Homo sapiens
tacgctggagtctctgagcttactctggcttgggaggctgcttgattcgtgaattttctttgctcaattaaacactttaaataaatttggctgaagtctttcttttaacagactataccaggagcaacaatgacatggaatcacagctcggtatgtgcatttattttaaaggaaaaggagtagtattgtcctaaagaacggattcttgtgcattttggtctcctggcctctttacactcttaggacttgttgaagactccaaaagagttttcattgtacataggttgtaagtcttgatgtttaccatattggaaattaagactcagaactattttaagcgcttatttactgtttcatttgaagacaacaatgatta

SEQ ID NO: 393945 - DNA, 269 bp, Homo sapiens
ccctttggttgagaagcccaaggccttagtgcatacatgaaaccagagcaaataaaataagggacaaggaggtgccataacctcattgcccggagggcctgggggccccagtactcctcggactaatttattgatcaaactgggacacttctgagagtaaaagggggcactcttaataattcagccaggacaacaagcataaactggactggcccaggcaacctgggatatatgaacccccagccaggtgccttcctggttctgggcca

SEQ ID NO: 393946 - DNA, 479 bp, Homo sapiens
gtattttcacagatgtctcatcttccttattaaattgtaaattctttgagggagagaatggtggctggttcatttttgcatccctagtgtcacattacagattttctttttctttcttttttttaaaatttaacttttaagtttgggggtacatatgcaggatgtgcatgtttgttacataggtaaacatgtgtcatgggggttggttgtacagattatttcatcacccaggtattaagcctggaacgtactagttatagttcctccttctctccctcccaccctccaccctccaataggccccagtgtatactgctaccctctgtgtaagtctgtgtgttctcatcatttagctcccacctagaattcgtggtatttggttttctgttcctgcattagtttgctaaggataatggcccccagctctattcatgtccctgcaaaggacttgatctcattctttttgtggctgcatagta

SEQ ID NO: 393947 - DNA, 297 bp, Homo sapiens
atttgttacatcgctcaggttaaaaatgtgtccacgcgctattgttgaaagagcacgcaggttaggaagtcttcagagcagggtcttgggagcaacccccaccgtcatgacggtcagaagtctccggactctgccaagtgtgttgcgggtggctggaacaagactgctcccaggtgagagcctctgcttcagagcaagacagatccaggtttaaaccccagcacgcaacaggaagaacctcaccagagggctgcaggatgtggcctcatccacccagagttacccagagctccccca

SEQ ID NO: 393948 - DNA, 157 bp, Homo sapiens
ggggagtacgtcaatgctgttaccccccagaagctgaaaaatgaagcaaagagtcaatggttgtttgagaaccttttattaattcaagttgtgggggtctgtgaccgtttttttttcttcatagtaaaatttttcaaatttggcaggaggggacatt

SEQ ID NO: 393949 - DNA, 466 bp, Homo sapiens
ctgtaatcccagctactggggaggctgaggcaggaggattgctcgaacctgggaggtagaggttgcagggagccaagatcgcaccactgcactccagcctgggcaacaaagcaagactccatctcaaaacaaaacaaaacaaaacaaaaagaaatgcattcaattatgtctcaataaactcaccttaaagttgaaaaattgtaagttgagccatcataagtcagggactcaacacggtatgttattattaactacagtcactatgctgaccatctccagaacttattcctcctaactgacatccatacctacacacactacattttccttatccattcatctgtcaatggtcagtttgattgcatactttggccactgtaaatgagtatcaacatgagagtgcaggtatcaactcaacatactgatttaatttccttttgacatatacccagaagtaggattattg

SEQ ID NO: 393950 - DNA, 523 bp, Homo sapiens
agggaatgaattggtaaagagctgttctacaggatgccagtcttttaaggagctgaggaaagcccacagaacaccaaattattacagggtcaggactgtgtcatttatctatttgcaggcacaagagtaattattttctcagcattaggcataagcttttcagaagaatactgccaggatgaaaaaatgcatgaaacagatatatgtgttgaaaactcagtgacaagatttgtgtaaaattcattgcttctgggtttctggtatgaacctaggggaatattggaaaataaccagtagattccttagcttacttatttcagattaccttttaagccttaaagattctgatttctttgtgaatgagacttcccaattgtaataacttcaaaaaaataaacataactttatattttgtaaatatccaaataaatgctcttatttgaaaaaagttttcacaagaaaaaatcttaaagtagaaaaattactcataacccatcacccaataaaattactttcggtttta

SEQ ID NO: 393951 - DNA, 401 bp, Homo sapiens
tcttgaaataccagaagcagcagtagtagcccaccttcctgtttgataacaattggcagggctccaggctggctgcatctgttgggacaggtattctctggtctccacagcctttgctcctacggccagctaacaccctcctctacctgccctctggtcttctgtccctgctgcctgcttctcttccatctagtccatccaagtgttttttggggaagtcacctggtaccttgttagggttaatttgtcttttaaattgggctcccaagggtatctgctagctaccctggctcacaaggctattttgaggctgaggatgtaacaactgtgaaaacagtttggaaactagtgctaagcaattgtttgtcaggaagcagggacttgtgggaactcaaactgtg

SEQ ID NO: 393952 - DNA, 374 bp, Homo sapiens
acgagcgtggagtctgtgtgcctgagtggaacgttgccatctcctctttgccctttgtatgccaggcttgcagatgcatctgcctccgtgggaggctttccattcatcctactcagcattacaggagcctgcgagatctgaaagcgcatctttatgtttttctttgttttcttccctcttattttactttgtggctgttttctctctccggaatcttattagatagagtgtgcctcctcgatggagggtctgtctcctaacttttctctcatgttaatctttttgtcttttgctcccattgggagatggccttgactttttatttcagctttcgattttttttttttttttttgagatggagtctcactctgcc

SEQ ID NO: 393953 - DNA, 260 bp, Homo sapiens
gactcaagtattctgaaaagctgcttttctgcaaagtatatgatcccctaaaacagcctcccagacattctaacccaagacaaaggacatcagggtgtggatctgcactggccctggggagcagggctagtagagactgcaggcattatatcccgccagtccccattctgaggcagggagcacggttccaagctgcccctgccccaggatgtcccatggccagatacgccttttctcagcaggctgcagtatgcttgcag

SEQ ID NO: 393954 - DNA, 499 bp, Homo sapiens
catgttggccaggatggtctcgatctcttgacctcatgatttgcccgcctcagtctcccaaagtgctgggattacaggcatgagccaccgcacctggccccaactatctatttcataaaaactttagacaaactgaagaggtttgtaggttaatatctggttttgtatatattacagagactttaatgttctttgaggccccaatatgtctgtacaattgtgattgtgtttctcctttgctttctgaattgtgaaagttttgcatgtttggggattgaagtaactgtctgcatgagatgtgttccatctctagctgcatgcacacttcatgtgaatttcagaggctcttatctttggaaggcatatttcttgaaatcagttttatgagaatctctatagtgaagatctaatcactttttacattgggcagaattacccatgtagaaaatgttacttgaaagtcaaaattttctcttttcatgagacagctattctgcaa

SEQ ID NO: 393955 - DNA, 600 bp, Homo sapiens
gtcttatactccaaccaaaacacttgtttcctctcaatcaaatcttatctttaggttaatctctcagggaccatccataaatagcagaggcagaatgttatccaatatccatcaggattcacccaaatgtgaaaaagatgaatataacatatattgtcttctgccatcaaggtcatcactgccaaaagctttcctggacaactatgttctgggccccatttctctcactcgtttgttgcaatacaatggttttgagagctactaatttccattaaatgacacatggtaacttccagtccaaatagagaatatttttggaattgcaggctatttaaggcaaatcttattaatctaaatgaagtagagtttacatattgactattaattttccatttttcatttacttctccatatagctttacagcccatgaagaggagtcttaaaatcaacatacctaatttctttctctacttcaagaaagatatgagctacaaatagaaaactttactgagaggaggtagacagttcagcctacttggattatccttagaggagctattacattatttacttctaccatagggtatgaacagagaaag

SEQ ID NO: 393956 - DNA, 179 bp, Homo sapiens
ccacctcagcctaagtagttggaattacaggcatgtgccacagtactcgactgaaatacacacaaactcctgttaagctatcccttcttccttatgcagtttttcttccgtaaaaatatgctaattgagaagtttataaactaaagaataaaagttctgttatccttttcttcccaaat

SEQ ID NO: 393957 - DNA, 300 bp, Homo sapiens
tcagagaaggggctgcagctgctactgtgttctctgggctccttgcattcagagcccggagctaccaagtgggagtcagaccacctgagccctcatgtcgtgaggatgccctagggactgtattagtcatctgtaactgtgtaacaaatgaccacagatttcatggtttaaaaccacacacgtactgtgtcacagtctctatgggccaggattctgaacggggcttagctgggtcttctgtctcctctcaagctggggtttcatctgaaggctcagctggggaaagatctgcttccaagc

SEQ ID NO: 393958 - DNA, 242 bp, Homo sapiens
aatatataattcagttatgttgctggaatcgatttgtgtttattttagatacatcaatcttctgaagctagttggtacatttgaagtatcaagcattcttgtgaaacccttagaatattagttagaagacatcctaaaaagcaattaatttgattttttccttacagttgtacaaacaaaggctatgaaagcttaagtggctttcctaaagttacagctgagattaaaaattattttttttt

SEQ ID NO: 393959 - DNA, 446 bp, Homo sapiens
tatttccacagggaaacattaaggaaaaaataatataaatcctggccaggtgcggtggctcaggcctataatcccagcactttgggaggctgaagtggggggggatcgcttgagcctaggagcttgagaccagcctgggcaacatgttgaaatcccatctctaaaaaaaataaaaaattagccaggcttggtggtgtgcacctgcagtcccagctacttgggaggctggggcaggggaatcgcttgcacccgggctgcagtgagccatgttagtgccactgtactccagcctgggtgacagagatgaaccctgtctcatagtcatcatcattatcatcatcatcaccatcctacatgaactatttcaggaaatataagaggaagaaatacctctcaaccaactttatgaggtaagtattatcctgatagcaaaaacagacaagagc

SEQ ID NO: 393960 - DNA, 626 bp, Homo sapiens
atggcagaaggtgacgggggagccagcacttcacatggctggaagcaggaagaagagtgagaagtggggaggtgctatacacttttaacaaccagactcacaataactcactcactatcgcaagaacagcaccaaggagatggtgctaaaccatttaagagaaaccgctagatgatccaattgcctcccaacacgccccacctccaacagtgggacttatagtttgacttgagatttgggtggggacacagatccaaatgatatcagtgtgttaaaaggaaaaggagataacagtgggaaatggatatttaacttcaatttgtgagtttttattttagagttctaaaattatgtcttatactacctatacaagtgctggaatattttctgtattaagtggtagatatataatatccgaatatcatacttaccttctttgaccttgcagtttaagagggcattttaagaaagtaaacaaacacattgatttttttttaaaggagaaatttttcagtaaacgatataggtacgttaacatgggcgatataggaaagttactgatggagagacaatcctacatagaaacctaaggaagcaattaactcagacacagagattgagaagag

SEQ ID NO: 393961 - DNA, 215 bp, Homo sapiens
ttggggaataaactattctataagttcggttcttttcttactccctcctctctactggaatcaacaaggaatgcaaaagctcaagtgctctgggtaaggctctccttcctccgggcttctacattatcattggcaggagcaaaggaaaggccgcagaactctgcatctcttggcatgttccttagccttccctcttcccctacacttcactacta

SEQ ID NO: 393962 - DNA, 359 bp, Homo sapiens
cctggaattgtctgaattaggtttgatatttctaggtttcatctgtctatactttggagtacttcattcctttaacttggagatgattttcaaaaatggcagtatccactgaagaaaaagccagtgacttaaaagtttctgggcaaccttatttatggttgtcgtaatcatggaaaatctccaaactccagtatttgtagtttttttttcatctgttactatgagagcaacctaggagccctttagaaaggcatcaaagtgctgggattacaggcgtgagccaccgcgccggccgtgttacagttcttaaaggtggcgtgtccggagtttgttccttctgacgttaggatgtgtgcgcg

SEQ ID NO: 393963 - DNA, 229 bp, Homo sapiens
tccagtaccatccccacattgtgcaaaaatgtggcgttaatgacctgttcagcaggtgttacttctctcctttcctaggatggcctgctttcttcctttgtgaaactttggctcaaaaaacatgccactttaggatgtgagggatggtaaaataactatagtcatttcctgcaacaagcttgtaaatgaaaactattaggaatattcaaaaataaatgtattgctatgc

SEQ ID NO: 393964 - DNA, 362 bp, Homo sapiens
ccgggggcgatggctcacgccggtaatccggccgaggcgggcggatcatgaggtcaggagatcgataccatcctggctaacatggtgaaaacccgtctctactaaaaaacacaaaaattagctgggcgtggtggcgggcgcctgtagtcccagctactctggaggctgaggtgggagaatggcgtgaacccgggaggcggagcttgcagtgagccgagatcgtgccactgcactaaagaaaaaggaaaggaaaaaagacttggtcgcagtcagtctgggattcgttgcaggaagcaaccaatcagaggctgaagtgaagttacaatgttacactcctgtgcaaacgtctgattggttgcaga

SEQ ID NO: 393965 - DNA, 428 bp, Homo sapiens
acttgatgtgtaagcagcttggggcggtgccctgcctactttacctgtgtgttctttcccccacctgggatcagagccaggcctagagggtgtgtggaggaagagcaggatgaacgggtcaaccgcaagacccagaccaggtgtgaacctagctctgtacctaccagccttgggtaagtcttgggacccgctccgagggtcctcaacagggctaagaacacaggtttgttgaaaggattaaatgacagaatggcaggcattccactcactatctgctacacaaatactcaatgtgtggtagacaatgacggtgatttgctaagccttctgaaggcagtcaccatgtgatccttcatgttcctccccacccaagttcccagtgtggcgccaggagcacagcaggtccgagactggctgtgatgacattc

SEQ ID NO: 393966 - DNA, 457 bp, Homo sapiens
gggggatgggggagctggataatggaaaaatcttttggctggaaaataagagactggaaatgcaggggatagcctagcaatttttggcattataaaaagccatttcacctctctggacctttgctgcttatttgtaaattgaaggtataagttattctgatatgctgttagtacaaaataatagcttacctccttgggtctccattgctaatgcagggaaatactctgatatctattcaaagctacagtttttatttctggccattgaaactaagagtgaccagttattttccttttccttctatttcttccaaatacatcctgaatcccttgtctcttttgttatgactctactccaagtcatcatcttgtcttgcctggacaatggcattagcttcatgttagtcaacatggctttcattcttaccatacaaaattacattctgtcacagccagc

SEQ ID NO: 393967 - DNA, 222 bp, Homo sapiens
agaagaaggaaggccagactgaggcatgacagtgtgagtcttcaaattttgtacttttatttcgatttcaaaggtctgccactatttttcatttctcaggcttggtcaggctttcatcccttccctgtttgtttgttttcctttctttctttctttctctccttccttccttccttccttccttccttccttccttccttccttccttctttctctttcttt

SEQ ID NO: 393968 - DNA, 208 bp, Homo sapiens
aaaattgtacttcctaacatggaaagattcttacagtatgctactcagtgaaaaagcaggttaaagtaatatgtaataactatattaataatgtatgtaataataagctaaaggtaataaactgtgataaccataaggcaaacatttatccagttcttgctataaccagctacactgctcagggcccttgatatcttttttttttttt

SEQ ID NO: 393969 - DNA, 623 bp, Homo sapiens
aacctactttctcagcttttatctttctgtgacctcccctttcatgcttcaatgtcaccttgggctctatgcaccctgaactttctggcttccaatttcttacactgttaactctacgtggacttgtccctcactgcaatctcatatctaaatcctagatcctatctgacatttatggttttactcagttgtcatattctctataaaagccttttttgtttgtttgtttgtttgttttgagacagtgtcttgctctgtctcccaggctggagtgcagtggcatgatcatagctcactgcagcctcgaccttctgggctcaagtgatcatcctacctctggctcctgagtagctaggactacaggtgtgcaccagcttcctggctaatggttttgtttatttgttttctccatagagatgaggtctctccatgttgcccaggctggtcctgaactcctgaactcaagcaatcctcccacttcagcttcccaaagtgctgggattacaggcgtgagccgctgcacccagacatttttaatctttctacatataaataacatttcttctcaactcttactattttatatgtgcttcctatgtctttcattcattcattcacttatt

SEQ ID NO: 393970 - DNA, 722 bp, Homo sapiens
gcagaataggttggaagcagaacaccaatgcttttccgttcccaagttctgtcatattgatgtcaacatgattttgacatgttggcattatcacccaggccaaaaagcgtgagggaaacagggaccagcacaaccagggtgttccccaataagagccttagacactctagtctgtttactcagcagaccttggccgaagtctgtcacgaatttggccttgcatagcgtgctgggaatgcagaagtcgccccaacacagtctctactcacaccaactcacagcctagacaaggagacagacgtgtgaaaccaaattatagtcactgcgatagggatctaataagagagtgtgtgtgtgtgactgatgagggaccaggggtcaaaaagggcttttccaaggaaggcaattggaattttccagagaacaaggaggaggacagtatagaaaaggggcagagcctgtgcaaaggcagagaggctggacagagtgtggcaagcagagggaaccccatgcatctctcttctccctactatggctagagtcaaggagagggcagcagggcaggttctgaagggcctctgacactttgtcgagggtgatagccatgggaggctgggagtggggatgtggcaaggtctgaactgcatttccggtcattctgacagccagtgtagaggaaagatgctgagggagaaactggaagcccagagacaggaccagtg

SEQ ID NO: 393971 - DNA, 192 bp, Homo sapiens
atacaggacaaattgtttcatccagctgtcaatggaggggcaaccagcacgaccatctcccaggacaaagagcattggaatattctgtttccttgatttatatatctcttcgtatgtttcttcatcaatttctatagtagtcgcggtttcttcctcatctcccaagatcatatttaaatgttgatcataagc

SEQ ID NO: 393972 - DNA, 135 bp, Homo sapiens
gtttcaagtttcatctatgttgaacaatgtatcattctttttattgtctaaaaatgtggtacatccagacaataggctactgagtagaacaggctaagagtggaattgctggattatatggtacttctatactta

SEQ ID NO: 393973 - DNA, 392 bp, Homo sapiens
gttctagagcaaaacaaggaaggcttttgaacttagcacataggaagcactaaacagacaacccgaagcaaacaacgacgacaacaaaaaacgcttaacatttaattaagtttctaccatgcactaagcctggtgcttcccaccttacctacattatttcatgttattatcctcatgttacagacaaaaagactgatgttctgaggtacttaagtaatacctctaagatcatttagctaatttgatagatgaggaaagttttgtgccagaaaggtagagtgattgccccttgatcaggtagctagccagtggcagagaagctgaaattgaacccacactttgtgacacctggtcctctgtcctttgctcccaaatatgctgtttcttgggga

SEQ ID NO: 393974 - DNA, 1486 bp, Homo sapiens
aagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaattatcagcaaggatgattctgatttaatctattcaacctatggggaagactctgatcttccaagtgatttcagcatccatgagttttgggccacgtgccaagattatccgtatgtcatgggcagatagtttactggatgtttaacaaaaggagggcattccaggaccctacaagagatggagatgtcattgcctgaagatgaaggccatactaagacacttgacacagcaaaa

SEQ ID NO: 393975 - DNA, 534 bp, Homo sapiens
aagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaaaaaaaaaaaaaaaaaaaaaaaaacttttgggcgcgcgcgcccgcgggcccccgcgaagaaagctttttaaaacacacattggcggtgggggcgcgcgggggccccagtgtgggtataggtgaaacagtgggccaaaggggttccccagaagaaaccgcgggccatggacacatgagggcctggggatttcttcaccaatttaaaaacgcgcccgggggaaaacgcgaggggttccggtgaaaaaattccccaagagaggggattccggagaggcacaaaaaggggacctttacaaaagagggggccccaaggggaagcccgcgaaattcaaatttagcccctcgcgggggggagc

SEQ ID NO: 393976 - DNA, 1382 bp, Homo sapiens
  misc_feature (58)..(58): n is a, c, g, or t
cttcccctggatcgttctctcctttctttctctttttccgctttctgtccttgtgtangtcatgatcgtttttgtcttcgaagaggctggagtcgtgccccgagctgcccgtggagagttcggtgggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaattatcagcaaggatgattctgatttaatctattcaacctatggggaagactctgatcttccaagtgatttcagcatccatgagttttgggccacgtgccaagattatccgtatgtcatgggcagatagtttactggatgtttaacaaaaggagggcattccaggaccctacaagagatggagatgtcattgcctgaagatgaaggccatactaagacacttgacacagcaaaa

SEQ ID NO: 393977 - DNA, 1514 bp, Homo sapiens
  misc_feature (40)..(40): n is a, c, g, or t
gacaaacacctctacgaggagccccgattttaatcgacgngctttcctttcttttcttttctttttttaagagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaattatcagcaaggatgattctgatttaatctattcaacctatggggaagactctgatcttccaagtgatttcagcatccatgagttttgggccacgtgccaagattatccgtatgtcatgggcagatagtttactggatgtttaacaaaaggagggcattccaggaccctacaagagatggagatgtcattgcctgaagatgaaggccatactaagacacttgacacagcaaaa

SEQ ID NO: 393978 - DNA, 402 bp, Homo sapiens
cttaagtatcctatccttgatttatcaccaactctccaccaggtctggtcccgttattcatttcctaacacttttaatacttttccttcacagtactcatcaagccttatcaactcagttaaaatctgtctccccattagaattgtaagtgccacagggcaaagattttatcagtcttatttaacttctgtatacttggcataaaacttaagtgactggtaaattttgattgcatatgtgaatgatgagttaaaaaaagaaacaaatacgtatctctggaagaaaattgtacaggatgaaattctaggatcttacacagagaattcttccccttccatgctttacagcaggaagaataaagtaaattttctaagtataataaatccataaaaacaggccggg

SEQ ID NO: 393979 - DNA, 322 bp, Homo sapiens
ccgagattgcgccactgcactccagcctgggctacagagcgagactccgtctcaaaaaaaaagaaaagaagttaacatggtctttatgaatctcatttctatctcagctagttcatgctactgtaactaccacggactgagtggcttgaacaacatttatttctcactgttctggaagctaagtccaagatcaaggcactggcagattccatgtctcttcctgttggcagatggccatctccttgctgttccacatgtggtggagagatcacctgtctcatgtcttttcttagaagggcacttatctcgtcatcagggctcc

SEQ ID NO: 393980 - DNA, 108 bp, Homo sapiens
ttgaagggttctcacgtttccctcagcggagcttggagtgattcctgaatacgtttcctctgcacttggcccctgcatcaaagtccgtgtgtgagcgtccactgggca

SEQ ID NO: 393981 - DNA, 276 bp, Homo sapiens
cagccctcagctgggactacaggtgcgtgccactgcacctggctgaagctcatcattccttggttgtaatgttcccattactcaacttgatggtctgtctttccttaaagcccagatccaacctgggatgagtgttcatttcaagagatcctttggccatctcagatacctgttttatccatttaaggtgctttttcagaagttatcaaagtcaaaggcatcaccctcatctgtgaagccaatgccgatgaaagcactatacctgctcagtgtcat

SEQ ID NO: 393982 - DNA, 377 bp, Homo sapiens
ctaccccccacccatgatgacccccaattcccatcaccactcagcacatttccttccctacctgaacattagcctcttaacaggaactgcattttgcttttgttcaccatgtctcactctgatacagtttttgctaccatttaccaagaaaagctcctacaggttcacaacttctctctgaaaacccttggggccatgattcagaattcagcatttttggacattagaaacgtagtaagatgcatacaccatatattctggtacaacccagagtagcagcccttaatcaaagacatcaacaagactgcagagaaacgtaagaaaattcacactcagagggatcagtgaagaccaaaactagccccccattggacagg

SEQ ID NO: 393983 - DNA, 126 bp, Homo sapiens
ctgcatacagctccatcttttaaactcaacaagaaaacatatcagaatgcaacacatcagagtgcaacatatcaggattcaacacatcagaatacaacataacagaaagaatgcaacacatcagaa

SEQ ID NO: 393984 - DNA, 369 bp, Homo sapiens
agcctagcgttaggggagggatgatgccagcagtcccttagccgccccggcctgtgtctgagtacatcatgtacccgccaagtccagtgattctgggcccagttcaacactaggacatgcctgggagttgcagtccttgtggcacagactgcctttcaagttcatgtaggggcccagagctctttatccgttggtggtgagacttgtgcataggtacttaagttctgacctggctatagctggtttaaatgttctctccattgcacatgtcagctgaatttggtctggtttcactttctgctgtaaaagggcagcactgacttcagtgcctcataaatgctgcactttctttctcccctgagcatagaa

SEQ ID NO: 393985 - DNA, 135 bp, Homo sapiens
agtggttagctaacttctggactatttgcggactttttggttctttggctaaaagtgacctggaggcattggctggctttgggggactggggatggccccgagagcgggcttttaagatgtctaggtgctggagg

SEQ ID NO: 393986 - DNA, 375 bp, Homo sapiens
cctcccaaagtgttgggattacatgtgtgagtcaccatgcctggctaataacccagtcctttagagttgctgcttattttccttcttcatagcacacaccggtctgagaaacccaggctattagacagtttgggatctctgaagtattagcctagtaaccacagctgtaagttgactcaggcgcggaaaaaagaaaagctggcaggctttcccagtgattgttttcttcctttgcttgctctgcaatctggccttggaaacacagggcctatatttcagtgttgaggtttggctgcttgaggggttgacctagttcacaggcacccaaactttgtggattaaatacacccatttcccctccttttttttttttga

SEQ ID NO: 393987 - DNA, 400 bp, Homo sapiens
caatcacttgctagaggtatttgcgtaactaaagaggagccaagtgttgatagccaagacaatgggaaaaagacctcaaaggcatttcagatatctctgaggcagcctctcacattacaggtcctgaggcctaggtgaactgaatggcttgctgggtctggcctagggccccacagtcctgtgcaacctcatggctgattcagctccagccttggctcaagaggctccagataatgctatgccacagttttggggagcaaaagccatgttaagccttggaagcttccatgtggtgttaaacctgcaggagtacagaatgcaagagtgctggagcctcaacaacctccacctagatttcagaggatgtatggaaaagcctgggtgctaaggcagaagcctg

SEQ ID NO: 393988 - DNA, 458 bp, Homo sapiens
gtctcattgcaacaaagtaccttgtacagttaatgaaaatgtgtgtttaccattatactcttacactgcaaagaaataaaaaatatccaagaaggtcagtactgttttcagtctatcacctataaaggaggactaaatgtgttcacaactccaaattaactatgttttcatctgcagactcagcctttccagacctgagaatataagtcaccctctttagaaaggaaaaaaagtcttcttggattaagtcagggaaaactgcctgattttgcatcacaccaggggaaattatggagatgagaaatactaccccagattttattctcctaggactctttaaccacaccagagcccaccaagtcctcttcatgatggttctgagtatcgttttgacctccctgtttggcaattccctcatgattctcctgattcactgggaccaccggctccacacgccc

SEQ ID NO: 393989 - DNA, 407 bp, Homo sapiens
atatatacagggatagggaaaacccagccagatctgtggggcatctgcacacaaagggcatgggagctggtgaagggtcagagaaaagagaaatgaatatttacgtccagaggagatggatgcagagatcaattccagaagggcctattaagaaggggtggagaagcacaaacgcctggacaaccagacagacgcagagaaaaagaccaacagatacaaatctgataactcacatgagtcacaccaaccgtaatttaggatgtccttcttcaaaatactgccaaactcaagacagttaatacccagccctcaacgtcctaaaaaggtgagcagcaggttaacatgtcattctccaacaagcagcaatatgaaagctttccagaaaatgagtgagttcctgagaagcc

SEQ ID NO: 393990 - DNA, 499 bp, Homo sapiens
gattggttggatccaggggctctggctgtgtcatccagactttatctgcatctctcagctctgcttttctctgttgctttcattcttagacaggctccatattggtagggagtcagagggggtgctgtgtctttaggttgcatcctaccagcttagcaatcccaactgaaggaaaacttctggaaagattgtttctattatataagcatataggagcaggtgttgtctctgcttctatggaaatctttaaaataggccagagtggctaggggtctgtctgtagttcttggaggctactgcgtgacccaggtaacttcagggtcctttcttaattttgtggttgcagatttataagtctctaggacttcccatttctctgtctcacatcaagtacattaggaagatgtccttggccgagcacggtggctcacacctgaaatcccaaagtgctaggattacaggcgtgagccaccatgcctggccgagaccccatctcttt

SEQ ID NO: 393991 - DNA, 745 bp, Homo sapiens
gattggttggatccaggggctctggctgtgtcatccagactttatctgcatctctcagctctgcttttctctgttgctttcattcttagacaggctccatattggtagggagtcagagggggtgctgtgtctttaggttgcatcctaccagcttagcaatcccaactgaaggaaaacttctggaaagattgtttctattatataagcatataggagcaggtgttgtctctgcttctatggaaatctttaaaataggccagagtggctaggggtctgtctgtagttcttggaggctactgcgtgacccaggtaacttcagggtcctttcttaattttgtggttgcagatttataagtctctaggacttcccatttctctgtctcacatcaagtacattaggaagatgtccttggccgagcacggtggctcacacctgaaatcccagcactttgggaggccaaggtgggtggatcacgaggtcaggagattgagaccgtcctggctaacatggtgaaaccccgtctctatcccgaccgagaccatcctggctaacacggtgaaaccccatctctactaaaaatacacacaaaaaaattagccgggcatggtggcaggtgcctgtagtcccagctactcaggaggctgaggcaggagaatggcatgaacccgggaggcagagcttgcagtgagccgagatcgcgccactgtactccagcctgggcgacagagtgagactctgtctcaa

SEQ ID NO: 393992 - DNA, 352 bp, Homo sapiens
ttgcttccagcaagaacctgtgatttactggtaatgtcaacattctggaaagttattagataataattaaacaccgtgcaggtcaacatctgaaagagatcaagttcccagatcaccatgcagtaggctcaacattaagttcacaggtagaaattcctaaaatgtaattgtcttgagaatctactgcaggacacggctaaagctgataaataatacaccaataccgagccgacttcaggcaccgaccttcacctaaaatgaccttctcctctgatttccagacgagtacacaatcctaatgcacactacaggcggaaaaccacaatcatggttttgcctcccccttctctga

SEQ ID NO: 393993 - DNA, 454 bp, Homo sapiens
tgcccttatatctattaccatgctttaaaaatgtaaggtaatagaatataaggtggatggaaaggggagaattatattacattcattaagtcagcagtgctcaaatagggactcgtatatgccttgagcatagatgagtcatttcagaggaaccacacattcttatgtgcatcactttatgaacagaaaaatatgtctcgctcaagatttgttttaccactttttaaatggtggacttccgtagccagctgtgacttggaaaatatacatttatttgcgaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggtta

SEQ ID NO: 393994 - DNA, 263 bp, Homo sapiens
ggccaacagcttcactaggggaataaacacagaggtggtgctggctggaatggagatttggaccgagggggacctaatagatgtcacagtggacttgcaaatcacactcaggaatttcaatcactggagacaagagatgctcttccatcgtgcaaaacacgatgttgcccacatgatcgttgggcatcaccctggacagaatatgggccaggcctttctcagtggtgcctgctcaagcggttttgcggcagctgttgtaatcc

SEQ ID NO: 393995 - DNA, 397 bp, Homo sapiens
aggccacaactgactaaaatctaaaaaaccgaggacataatatgaatttcagtgacattttcagtaaaaataaaatctttattgattatattatcattcactgagtaatcatgaaccagaagataatgggcatatcaatttggaaatgtttgtgacaatacagctaaacacatttttataatacagttttcttaagtcatttatatgtgtatctatttttttttcaggtaaagaactcatattttatccttatcatgaactttatttgtctatagagaaaaggcctatctcctcctaattatctttataaagttcatatacatgtaatattttaatggcttccaaatcatttttgtggtctataatacacccatggcatatgtttataaatatttta

SEQ ID NO: 393996 - DNA, 231 bp, Homo sapiens
taaaatttgaagctagaaaaacgttggtccctataaatgagagtcattttgatgacatcgtaatattcattaggaaacaatgtagtatgtctcctttgatattctctgatttcagcaaaaggtgtataagtttagtttaggttttctctctatacaccatacatacgtgtgcacatgggcactcacacatccacacatgtgtgcatacacatatacagtcttcatagagat

SEQ ID NO: 393997 - DNA, 139 bp, Homo sapiens
ataaaccagcttgttggatgttgaggaaaaacgcagacaggttactcaataagctgtagtatatataaattgaagtagtcaaaagaaatactttaagagtcttcgtgagaaaccacaggctgttgagagcaacctatgg

SEQ ID NO: 393998 - DNA, 350 bp, Homo sapiens
tgtatacctaagtattgcattgtcttcattgtggttgtaaatggtattttgttagggttcaacatgaaatgtgattgacttctttgtgttgaccttatatcctggtccttcctgaacctagcagtggtattttataaatttctcgtggaaattttaatgtgcagccaaggttaagaagcattcttttagacaaagaccagtggtgatatttagtgcccttaaaatcttgtggtttccaatttcaataccatttagcaatccttgggtgtatgcctgcatgattctgtcttctaatatccacagtcgtcattacaaacgttcccccttcttttcagcccttctttccttac

SEQ ID NO: 393999 - DNA, 346 bp, Homo sapiens
ctggactggactaacccaagctggacttaaactaacttccatgccaagccaataaaatttgcttgtcttctatcactccatctatcttagtgaagtttaaaatcagtacatgagtctgagaatatttccattttcccagtagtgtggctttttcctttgtgcccttcattagggctggggtcggtgggtgctggaaaataaacgttttcagtaatccttgtcagtgtccattcaaataccagtaattcattttctgatagccttccaatatgtaactatgtttagaggccctagaagtctcttagttttcaaagatgtgatttgattattggcgattagggttagt

SEQ ID NO: 394000 - DNA, 421 bp, Homo sapiens
agctcggcctcccaggttcacgccactctcctgcctcagcctcctgagtagctgggactacaggcacccaccaccacgtagagatggagtttcaccatgttagctaggatggtctcgatctcctgacctcgtgatccttccaccttggcctcccaaagtgctgggattacaggcgtgagccactgcacccggccaaattaaatttgtttttaaccagattacctgaggctcaatctatgtcatcctaattcccactctggtctgatatggcttgactcctgttccttgtttttgctagcccagggggatagttttgacctgtgctctttgtaatgtacatcatcgctatttaggatcttttctaggaagcattctttctagagatggtcctatgtatttgccagacctgttttcttccttg

SEQ ID NO: 394001 - DNA, 412 bp, Homo sapiens
ttagcatttcaggattgcaaatatcacactttggaaaaataataatgtttgcttcaagaagaacagattggatctgtattatagaaatggaaacaacaaaatgtggacaattttagtaaagattttatgaattaaggaagctttacatatcaatggaaaataattgaggactagcaagttaccgcagtagttggtggcaaaggctacagcagttctttaaggattcagaaaatagttgtgtgcatgtgcgtgtgattgtaaaaacatcatgcattccatttcccatccatggtggctaacactattcaaaaaggacattttcagacctgggatgtcttcaaaacaaaaccaaaaaaaattctaacgatggctgttcctgtgttacccaccacgctcctcacaaatgcttggc

SEQ ID NO: 394002 - DNA, 707 bp, Homo sapiens
gaaccgtttgtggtggacttggtgtccacatagatctaatcagtggtcttagcttttgtgctttcaaaattaccacagtttttgttctaaaactatcattcccttgattttactttaggcatgctatctgtgtattttgaaatttaaaataacattaaaggagaaatgaaattattttgtttgagaaagaattaaaaggttaaaacatcttgatctaaataattttctaatgggagatttggtacatccccagaagttgtctttggttcagagaacagtcttcagacctagaaaggacttgaggagtcccagagaggagccacatggtgtgaaccattcgattctcacaacagaatggataagaacaatttcaaccatgaaaccgtgcagatgttcatattttgaatagggtaagatcggtgccattgtcagaggaaaaactcctggccatcacaggttgggagagaaagtttccattgtaaagaacactcaaatgccatttaaggaaatgggttcttctgccctgattctttggaatatttagggccacgtttttagtttttgacatcataaaaatttcaaagtattctgttctgattgccatttcaaacaattgactggaatttcagagcaatttcataagagtaataccattagaatttttaaattacctataatcctatatgcctaacaagtatgttcatgct

SEQ ID NO: 394003 - DNA, 307 bp, Homo sapiens
gctttggaaaaaaccatgcacacacacaaagatacaaataaagtgtaagtgaagtaatcagagtaagaggttggggaaggtaagtcgaaaccaaaagtgtaattagtatacagattataggctctgcagacctacacggtcacaggaagaccaccacatatttggctgttagcttttgaacaaagccaatgcaaagaggataacatgaacgatgcacggttcccagtgtctgtgccaaaatcgtctaagttcagtccggtctagaaggccgggggatggagctgacctcaggggaaccctgctgaag

SEQ ID NO: 394004 - DNA, 277 bp, Homo sapiens
tctttcttgatcagatgtcttctgtctatccactctggctctgtctactcccttcccaacacatgctctattttaggtaaccatggtagttttgttttgttttgcttttgcttttgtttttggagatggagttacactctgtctcccaggctggagtacagtggcacgatctcggctcactgcaacctctgcctcctgggctgaggcaggagaatggcgtgaagccgagatcccgccactgcattccagcctgggcaacagagccagactccgtgtc

SEQ ID NO: 394005 - DNA, 340 bp, Homo sapiens
gccaacctctgcctcccgagttaaagtgattctcctgcttcagcctcctgagtagttgggaccacaggcgcgtgccaccatgccctgctaatacttgtatttttttgatagagatgagttttcaccatattggccagactggtcttgaactcctgaaaggagtttttggggggtgataagaatcttgaaaaaattacctcctttccttcatctcaccagtcactgagttccttttcctggagacaaccattattggcttgttgctccatccagtgcttaggatgtctgtgtaaaacaaatgatacatagcatacacagtgctctgcatctttttattcat

SEQ ID NO: 394006 - DNA, 480 bp, Homo sapiens
taataactaatgaagttgtcattatattacatttggcagacataaagttaaaattgtaattttggagttgttgtttctttggctataagtgaaatatttttctagagcctcagatactttcattggctattgaaaatcttacagtctatgagcactacgctgttgtactgatggataaaatagctctggccctgtctgcatccttggaagaaagaaagggagacattgaaaataggtaaggacctcaactttggagcttatgttgaactgaccatgattattgtcagttttacaatggagttggggcctcctctgcttaaaacaggctacctgcctaagtgccgttagtaattcgttactcctagggcacacctcttttgaaaatctttataagaatgtgatgcccataaagggtaataaacccattttaaaggtctgcctttgtttttttaatcacatatgttttcctaagcaaaaaaa

SEQ ID NO: 394007 - DNA, 208 bp, Homo sapiens
cagtgtcactgaattgcccctgacttagcctctccatcagccaacaggttagagagttctttcctctgtgtggactggggtctttcctcttggaatctgattttaatgaaacaattaggttgctcattttgaaataaccatggcttttagccaaattttatgctactctgaataaacaattttgcttaaaagattttagccacttcca

SEQ ID NO: 394008 - DNA, 321 bp, Homo sapiens
aaaaaatgcaaaatatgtagaactgaatgatataaaagatatttggccgggatggtgactcaacgcctgtaatccctgcactttgggaggccgaaggtagcgggggagggcggggatcacctgaggtcaggagttcgagaccagcctggccaacatggtgaaaccctgtttctactaaaaatacaaaaattagccgagcgtggtggcacgcacttgtaatcccagctacttgggaggctgaggtaagagaatcgcttgaacctggaaggcagaggtggcagtgagctgagatcgtgccactgtactctaggctgggtgaca

SEQ ID NO: 394009 - DNA, 428 bp, Homo sapiens
aaagagaagcccttaaatgatatgaaaaaagagagaaaggcctagtgtcctagtggcccagcggagcccagttccccaaccaattctctagcagaatgaagccttatgagtaaccactgaccagatgagcagaacaaccacccagccaggcctagaccaaaccccagaatcatggacaaatacaacagttgctgttttaagccaccatgttttgggatggtttgttactcagtaacagataactgatacacttccacgaggccatgggttgtgctggagtgccctggtgatccatgccaacaatgggatcatgcaaagctctgtgcacaggcaaatatatgtctatccttggtgatgggtagtgtgaacataaagagaagccatacagagccactgccatctgcaagtgctccctcaagctactggtg

SEQ ID NO: 394010 - DNA, 425 bp, Homo sapiens
atctgatttggggttcaagagccagacagcaatgggggaaggaacagtaacctttggggacatggtaagtgcttctcagctagcactgtggtttttcttcctactctagattcctgagcatccttgcacaagtgaagcagaaatcagatgagagttgaagtacattaactaacttttctttttggtaggaaaggtcaaatgcgtttacttgcccttgatggctggctatcattgcttccggaaaagacgcagtgtacaggctgtagggtctcagaataaagtgcccccaagaaataaatgaatagcttattacccacgcatccatttctcctagaagccagccagtgttggctaagcagttagcatttattcagccacagagttacaggggagaggagaatatggtgcgcgtccccctgaagcat

SEQ ID NO: 394011 - DNA, 222 bp, Homo sapiens
tgcatgaaagctgcttgcacagggcctggcacacagaaggtggtcagagaagctttagctttcttttctctacaaggactgtttgtgtccccctgccccgcccccgcacatgtgtacatacccactgtcctgattccctgctgctgcaaggttttgcatgacttgactcttccctgcttctccaacctcttctcctgccactaggcccctcctgccacacag

SEQ ID NO: 394012 - DNA, 540 bp, Homo sapiens
cacagctgctttagcaagttctagattaataaaaataaaattaactgtcacttaaaggagacaggaagaagcggggtttttttgtttgtttgagacagagtctcactctgttgcccaggctggagtgcagtggtgctcactgcttctcgcctcctgggctcaactgatctcccgcctcaacctcccaagtggctgggactacaggagcatgccaccacgtctagctaagttttgtatttttcgtaaagacaaggtttcatcatgttgtccaggctagtcttgaactcttaggctcaagcaatccacccacctctgcctcccaaagtgctgagattacagacatgagccactacatctggccaataggaagaagtcttgaaagaagggagatgatcagaaggaaatgaaaggaagtcactgaaactttaaatttactagaaggaaaataactaaatcccagttttaaaactgtgaaaccgagtttaaaatgtagaaggaatatagacttgctcatagtttgtgtacttggtagaaacaaaa

SEQ ID NO: 394013 - DNA, 194 bp, Homo sapiens
ctggagggaagtcagcaggcaggactgaagaactctcagcactgaggagaatcttaggaagaggccatctggccccagagaagtgaaatacatgccagagtcacgtatctgggtggtggccatgtgcccgttggtcctgatgcccactctttctgtttgtggcctcccaataaatagaccggggtgcccagccc

SEQ ID NO: 394014 - DNA, 363 bp, Homo sapiens
tcaccacctaccactgaatctaacctacagctcccagtggttcctgttgcaaatggaaaagatcagctggaaagtgtgactgcctaaaaatgctgagagagctgtgtgtcttcctctcagcttagaccccccatcacacccccatgcaaataccagctgggaatgcacagaagtgcagcctggtttagtttttaaaaagagtaaacatcagtcatggggtcatatgatctccctgttaggttcacaggaatctttagttaatgtctgttacctaagaattatgaaaacagaaacaaccactaacaaggtgtcctaaaaacaaaacaaaccccgcgattagggttagtgggtaccgagcctcga

SEQ ID NO: 394015 - DNA, 804 bp, Homo sapiens
cataggcagcacaggcatcaagatgtccaaccgagtggtccgctgggaagccagccactctgggaactggtacacagcctcaggaccacagctgaatgcacagctagaaggttggctttcacaagtaaagtctacaaaaagacctgctagagccattattgcaccccatgcaggatatacgtactgtgggtcttgtgccacccatgcttataaacaagtggatccgtctattacccagggaattttcatccttgggccttctcatcatgtgtccctctctcagtgtgcactttccagtgtggatatatataggacacctctgcatgaccttcgtattgaccaaaagatttacagagaactgtggaagacaggaatgtttgaacgcatgtctctgcagacaaagatgaacacggtattgaaatgcatttgccttgtacagctaaagccatggaaatccataaggatgagtttaccattattcctgtactggttggagctctgagtgagtcaaaagaacaggaattcggaaaactcttcagtaaatatctagcagatcctagtaatttctttgtggtttcttctgatttttgccattggggtcaaagattccgttacagttactatgatgaatcccagggggagacttatagatccattgaacatctagataaaatgggtatgagtattatagaacaattagaccctgtatcttttagcaattacttgaggaaacaccataatactatatgtggaagacatccctttagggtgttaaatgctatcacagagctccagaagaatgga

SEQ ID NO: 394016 - DNA, 197 bp, Homo sapiens
tgtctgggagtgtgacttggaatctattactgaagattagaggaaaatgtagcaaattgtgatctgaagcatttatggatggattgatggattgatggatagggattctgactgagttaggtagtctatagtctcagacagttgtggaagctccattaggtcatgagcaacccagactccttccaattctgtgccct

SEQ ID NO: 394017 - DNA, 457 bp, Homo sapiens
tgttcctttgacatattcctattattgtgacatgtttacctgcttgcttgttttttagcacttccttactttctggcacttcaagatgccctaggctcatcgtctatatttttttgtcccagtcctagagttagccatttctccaagaagctctggttcctcttgctagagaatggtattagaagacaaaatttgtgtgctagatatactctgggcattttgcttctagagtctctcagcttacaaaacaaagtaatatatctgggtatactaatctgaatacatacacatattataacatttctatatgtaatcaactctaaactgagctaaaacatgaattactactaatgactctaatccattctcatatggaccattctagcctcctcaccttgcttacctgtaaattcccactccaactgtaagaaacctggctcccactatccatcattga

SEQ ID NO: 394018 - DNA, 155 bp, Homo sapiens
gaaagcctgttagcagagcacggaccagtgtctccggagaatgctattctcctacatttccgaacaggttatcaacgcacagatcgatcactgcctctgtcccatcgctccctgaagtagctctgactccggttccttgaaaggggcgtgtacag

SEQ ID NO: 394019 - DNA, 639 bp, Homo sapiens
ttgagacagagtctagctctttgcccaggctacagtgcagtggcacaatcttggctcactgcaaactccacctcccgggttcaagcaattctcctgcctcagcctcctgagtagctgggactacaggcgcctgccaccacgcccagctaatttttgtatttttagtagagacgtggtttcaccatgttagccaggctggtattgaactccttacctcaggtgatccacccgcctcggtctcccaaagtgctgagattataggcttcagccaccacgcccggccatccctataaccattttcatatctatggttctgtgatattaaatatattcatagtgatgtgtaaccatcaccactatccatctctagaattcctttcatcttgtaaaactaaaactctgtacccgttaaacactaactttctattttcgcctccccgtagccctggcaacagccaatctgctgtgtgtctctatgaatttgactactctgagtgcctcataccagtggaatcagatagtatttgtttttggtgactggctaattttacttagcgtgatgacctcaaggttcatccgtgtcgtagcctatgtcagcatttccttccttttaaggctgaatactattccactgtatat

SEQ ID NO: 394020 - DNA, 366 bp, Homo sapiens
aagcttcagatgactcagacagccaagtgcagatgctgacagctgaatatacaagtctggacttcagtggggcaactgaggctaaagatagagattaagtcattggtgtatataaataatacagatggcatttttcttttctttttgagacaagagtctcactccgtcaaaaaaaaaaaaaaaaaaaaaaaaaaaaaaaaaaaacccctttttagcccccccaatttttgtggcccggggagtgtctttggattttttggggcttcttggggggggttccccccggttttgtgtggtgtttccaggtgtccaagtttctccccattggttgtgggttttacccaacgtttttatggaacccttttt

SEQ ID NO: 394021 - DNA, 363 bp, Homo sapiens
ttgtgattgcgcaaaaacgaaataaccaccttccactttgggttaaagccacaacattctctcactgtgctgcttaaagaaggcaaagaagaacaaacgagcatgggctgatggcatttttgaagtttctctgctaaagataagtaattcaatataagtgataatttggggtttagagccgtcaagaagctgaaggggagattatttatagtatttttttttaagccttggtttcaaggtggccaaaagtcctattaattcgcagttcccttcacaaaacagttcagcattcggtcccaggagaaatggctgtttaagagtttcatttcattgagtatgtagttagagcactcaatatgccat

SEQ ID NO: 394022 - DNA, 334 bp, Homo sapiens
aaatctcccttttatccaaaaggttgagtgcgtatttttgaagtttattcatttgccaaacatcttggggcacatcaataagtatggattttgaagacatggttaatttcatctcgagcagacctgggtttgggactccacctcccttatgactgctcatgtgtggtttctacagcaagttaccaacttcccttgatctcagttttctcatacataaaacaggactaataacagatctaccttggagagcattctcttcatttgtttatttatttattcataaatttgacgatcttttttcagcatctagtctatgctaatagccactgggctg

SEQ ID NO: 394023 - DNA, 180 bp, Homo sapiens
gtagcattcctatgatttgcagtaattgatacattcattaaaatgaattgtttcttaaaagtttcaaaaaagccatatgaacttaaagacattctgggagataattctttgaaaatgtcttcaagctcttgcttgctttttgagttattgaaattttcaatgtctttacgcactttggta

SEQ ID NO: 394024 - DNA, 173 bp, Homo sapiens
agctaactctgtcatgatacataatcacctagtgccgtccttattttacacttgacaggttatgtggccaagcagctttcgtgagttgctgtaaactctgtttctggtctttccaagcagcaggccagcttccctttcccctctaccctccacagtgcctcccacagtcttct

SEQ ID NO: 394025 - DNA, 770 bp, Homo sapiens
acccctcatccccccatggagtaggcagttcctattggtatcctcattatataggagattgaggcacacagagatcaggcaactaggagagaacacacagtgcctaagtactcttggcccctgcactgtcctgctggtgtctgctgttgactttgacctttagaagggcaaagatgaaacatcaaggaagaattcatctatggtataagaacaacatatgatacggctccaggagcagaaatcattagaggtgcccctcgggactgcagaacagaattcctggggttgattgtgcgcttaaagctcttggtttaattggagtgaatcagtattgctgtgaatttccctcaaatgttaggggtcaagtataggattgtatatctagtattggaagccagctggcgttctaagaccactgaaatgttgaggaatgagtcttaaggactcagaaaggcagaggtaccccaagtaaaggtttcttttcaaagtagtgcttactatgtgccagacacagttctgagcactttatgtatctttacttggttaattctcacaaaatctttacaaggtagctactgccctgttttatggataaggaagcagaagtgcaaaacagctaaattacctcatcaaggtcttgccactagaatgtggtggacccagggagtctggttccggcatccatctgcttcattcttttccctttaaaaattttaattttctttttttggttataacatacctttcccaagacagtgagaacagaacag

SEQ ID NO: 394026 - DNA, 350 bp, Homo sapiens
atcgtgatggctgactctagagggtccacagtgacataacaaaatacacattttgttagatttatatataagtatttcatttttgggggtgctcatataaatggtaatgtgcttttaatttcaaattccacttatttgtcactggtatgtaggaaactggttgacttttatgtattaaccttgtatcttgcagtcctgctatataatctcttattccagaaattttttttcacttctttctgattttctacatagataatcatatcatctacaaagttttatttctctcttcctaatctgtatacttttaatttccttttcttattagttaggacttcctatgatgttgg

SEQ ID NO: 394027 - DNA, 509 bp, Homo sapiens
aagggaaagaggaagggaaagggaaagaggaagggaaagggaaagggaaaggtcttattctcacttctcaaagatctaccaacctagaatctacttcacaggaaacacaccacaggagtaacttggtttgcaagcaagatgggctctcttgacagatgctagccttccatgggacccattccacattcctgaacagttttctttatttctataactcatatagtcatctttgtgttgtgtatttacttgggaggggccctctctaatctaaataggtatccatcataattcagcctaagataagtttaaaacaagggcagatgcacagaacttcttatgaccttgaggttgactttctgggtcaataactcaaattgggtgtcgctgtaggaaacatgacattctgataacaatagtggaaccaaacaaaaaataaatgcagcaaaaaaaggatcaccttaaggatttcttgtgtgaaccaggaatagaaaaagaaatgaatagagttg

SEQ ID NO: 394028 - DNA, 385 bp, Homo sapiens
cacaaattcatttattctatggacttaagattggaaagccctaaaccaaaccctactatttcctccttcatacttgcttagctttcctatcctagctgaactcaatggtagtcaaagtttgaatgaagcagacagatactgctttacattttctcaggtatttgaagtttattctgattacttaataagatgacctaaaactgcctagtactgaaggtgtgcaggaatgtttgccaaataataaatcagaaccaacttcagagtcaaggatgctcactctggagcactctaaagcaatactattcaaaaagagtcaggaaagactgcaccgactcccagaacatattctctcactccgagtggactgtctatatcctgttgctct

SEQ ID NO: 394029 - DNA, 214 bp, Homo sapiens
gggcaacgagcagagcaggtgactgtcgagggcgccccactcagggggagcagccagggaaggccccaaggctgtgacatcagcaaggagccccggggtggagaggaggccaagggtcaggcatgcccccgagctcatcacataaagccgggggaaaccgcagcccctggccttgaccctcagcccagcgtgagacccatctggaaggaggagg

SEQ ID NO: 394030 - DNA, 444 bp, Homo sapiens
catctctgccctctctgggccattcctgttctcctatcttcccccaggcctcaaggctgggaaaggcggcacagagatggggttacaattcctgatccccagggcaagggtgctgcccttctcgcacctgggccaccctacgagccctgagacacagcagtgtgggcggggaagcctgggcctccagatggatggtcctgggtgcatctggctctgccactaggggctgggcgaggacaaccttcctgaacaagacaagcttgtaaagtgccccctgggctgtccgcaggagaggcccagcagcagggcctggtttacaggtccaggcttccctaggttctgcccacagctttccccggagcttccttggtcctcatctggcctcactccagctccgtggggtccctggtcccccaccccaccagacaatgccaccagctccca

SEQ ID NO: 394031 - DNA, 265 bp, Homo sapiens
gattaatatttcaaatatacttaaccctgcgtctaattggggctgaaaacagttgaatccaatgaaatcagacttgctggcagttagaggaatcttatttggagacatcataagggaaaggagagaaaacagaggaggtatttgaaatgggaaatttaaaatcactcttgaattttctcaaagtgctgtagatactgaatgacttatcattgtgtgtaaactaggtaactccttgtctttctgatgcctttttgctttttcatgt

SEQ ID NO: 394032 - DNA, 353 bp, Homo sapiens
tccagcccagacccccttccttccataattcagatgatcaatcacagccagctgcctgctatctacctggtggcctcacgcacattctagaatatggacaaaaggaattccccatcttccttccctaaaattatcctgcctccattctctctatgcatttggtgtctcctcccactacccaatcactgaaactagcaacaggacattcctccttgacctatccttttcccacaccactcatcaacagtcagtaagctctcagttttgttcacaaaatatcccttaaatctgtgtcctccccttttcattcctgcttctcctactctatttctcaatcaactctggattctcac

SEQ ID NO: 394033 - DNA, 823 bp, Homo sapiens
  misc_feature (519)..(519): n is a, c, g, or t
  misc_feature (529)..(529): n is a, c, g, or t
  misc_feature (533)..(533): n is a, c, g, or t
ccaggctggtaccgcccgaggtatgggattgcaagtttacctgctgactcgtgaagaggatgacgcatcttcttaaactgatttaagccgaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaacgttcagtgctaagctcaggatatcaaaaaactccccaggaatgggccccacaaactgcaagaataaggaccaggatgcaaaatgacagcattctgaaatcagagcttggaanccagtcaccntcancctccagccgacaagtgactggacaaccccaaaatgcatcttttgtcaagaggaaccggtggtggctacttcctctgatagctgctcttgcctctgggagttaatggttctttagtactcctgaggtagaaaccactgctgttcaagagttccagaaccagatgaatccaacttaagaattaagtaccaaggtcaacgatgagaagctgtggaaaaaggagccaaacattcctggaaaaacatcttaatagctcccatcctcggtctcagcttgtaatcttactggtcac

SEQ ID NO: 394034 - DNA, 595 bp, Homo sapiens
  misc_feature (519)..(519): n is a, c, g, or t
  misc_feature (529)..(529): n is a, c, g, or t
  misc_feature (533)..(533): n is a, c, g, or t
ccaggctggtaccgcccgaggtatgggattgcaagtttacctgctgactcgtgaagaggatgacgcatcttcttaaactgatttaagccgaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaacgttcagtgctaagctcaggatatcaaaaaactccccaggaatgggccccacaaactgcaagaataaggaccaggatgcaaaatgacagcattctgaaatcagagcttggaanccagtcaccntcancctccagccgacgctggagtgcagtggagtgatctcggctcacggcaaccgcatcagccgtt

SEQ ID NO: 394035 - DNA, 248 bp, Homo sapiens
aacatctcacaatccctcctgtgatggcagatgtctccatctactctacagacgcctgcaactatcattcccttgatccgtggtaattaggagggaactcctctgtgaagaactgcttctaccatcctcttttagaaactctttctccactgggatcttgaacattttcaaaatctggtgcaaggtctttatttatttatttattttttttgagacagagtgtcactgtgtcacccaggtgggtacgt

SEQ ID NO: 394036 - DNA, 414 bp, Homo sapiens
gggctcatgccattctcctgcctcagcctcctgagtagctgggactataggcgctcgccaccacgcccggctaatttttttgtatttttagtagagacggggtttcaccgtgttagccaggatggtcttgaactcctgacttcgtgatccacctgctttggcctcccaaagtgctgggattacaggtgtgagccaccgcacccggccttttgagtcctattttcatccgcatctctatggagtctgatactgccaattcctgagtctcgggtatacatagatcttctcagctttccacatttctacctgaagattcagattttcttgagcctactaagtcaattatttgtccttctctgtagcatctgtacttctaaatttttatcttctactggcttggtctttatcctttgg

SEQ ID NO: 394037 - DNA, 408 bp, Homo sapiens
ccagccaggccactgggggcactgggcaaattgaaaaactggatgacccggggcagtggtaaggacctaaatgggcccactgtgtgtgaaaaagctttcctaagccctagtcatcatcatcaagaattactgtaatgagttgattagggcataacttgtgtccgatcattgtcaaagagcccatatcttccttatgtacaactcatttacttgcagaaaaaaggattctactacaattatacttttttccacttgccctgaacttttgtcttctaataataatgttcccaaggtcattcctcatacttttaggccaatatttagagctagcgaagaggatacagattaagagctggcacctttgggcccataagccgtaggtaggcagagggccaggttaaaaaaaaa

SEQ ID NO: 394038 - DNA, 508 bp, Homo sapiens
cggctacataagtttccttatatttttgaattatgatgtaaaagtggtctacataaaatcaaggaaagagtactggctttattgcagttcaagtaccatattaaaaatatatatatgtgaatgtgtgcaaaaatacacactcactcacatacaccctaaattcaattctatattgaagcatcaaattgaaattggttcttgaaaattccagtccttcgtgattagaatattgagagggagagtttgctttgattttttccctctttactctctaaagcattttctcccttaaaatacaccagaaacttctcatataataagggcaagatgattaagagtatgcaattgtacttgctaataccactgcaatttacggagtgtggaactactcagacctcccaacattgccaactgggctcagtgataggactaacgaggttgttcggtaccacagcaagtagaaattaaaattggaagagcaatcgtgtttgatactgggggtcactaa

SEQ ID NO: 394039 - DNA, 348 bp, Homo sapiens
cattttctctctttttcattaatgttatattcagccactaaaggtgaaagaaattgaataaaggcaaatttgaaatatgcaatagctcacacaaaatagtttaagaggagccttagaaattgctttgcataaatataacaccgaacacttaattgtcttctgcctcttaatgtgcagcttgcactattaaagccaattgcttcctatgtaccttataaaacagaaatgctgctttctcttctccaaagaataacctgataaaaactttctaacctcgaaaatcttgctttatacttttctttaaaaattcctcttcttaaaccacagatagcacttattacataatag

SEQ ID NO: 394040 - DNA, 257 bp, Homo sapiens
aagaaaaaatattctttaaaataatttatcttctttagcctatcgacattataattaccatggataatttcactaagtggtctgagacttgaaagtattcccaaccaggaggtgactaatggaagtagaatttttgatgagctttaattggttgttgagcttgaggagttatttgaactgaagtaaaataagtaatctcaaatattttaagtccaaaatggccatcgatatctacaaggtcattgagtgaatttatt

SEQ ID NO: 394041 - DNA, 368 bp, Homo sapiens
gaatgatcaattaaaaaaaaaaagaaaaagaaactgcctctgttaggatcaaaggttgagaaagtaaggagaatacagagcttccttccataacggtaggaaggcaccaaatttgaacagagtaaggctcctagtgccactgcctaaaaggattgagatgagtagcataggtaagttctgctccaggcttcagatcacaattctagtaacatagcacagtgagaacatttttattttttctggacaagttttgcctccccatcgacaggttacataaaggaaacccaatttttcattcatcagcaaagacttccaggaaaagggaggaaaatttcctgttctctcttaaatgttgtcaaaagatttaa

SEQ ID NO: 394042 - DNA, 371 bp, Homo sapiens
gctaggaaccactactgccctttacttttaaaaattattatgaactgattgtaactatttatgaaaaggtttgaaaatcttagtgggagaatatgcaatgtgacttcagattggtattaacaataatcctcaaccttatattgaaggctttcaagtctgttttttcttcttcttcttcttcttcttcttttttttttttttgagacagggtcttactgtcacccaggctggaatgcagtggtgcaatcgtggctcactgcagcttcaacttccctggctcaagtgatcctcctacctcagcctcccgagaagctgagactacaggcatgtgccatcatgcctggctaatttttgtattttttgtggagatg

SEQ ID NO: 394043 - DNA, 167 bp, Homo sapiens
tagctgttcagaggattccctctggtggaagtgtccaatatgattccagcgtatgagaaacagtacacaacaggcatatacatttcattagtaagtgtggttacttaagaatgaaattaggctgggcgcagtagctcatgcctgggagccactttgggaggccagca

SEQ ID NO: 394044 - DNA, 239 bp, Homo sapiens
taaagatctaataagagtaagtagggatatccgtcaccttacacagttgtcttttgttttgttaaaaacagttgaaatatgtaattattgtaaactttagtcatcctactgatctatcaaacactaggtcgtatttcttctatcaaattgtatgtttgtacccattaatcaacctctttttatcttccccatccccaccccttcttggcttctggtacccaccaatctgcattctatct

SEQ ID NO: 394045 - DNA, 420 bp, Homo sapiens
cagtggagtgctaccacagcctggaatcctcagtactggagcctctgccacccagctggggtctcacgctcagcccccgaccatccccagaggccaggccacctgtggttctggggtcccgaggctcttgggagcccaagctgctggtgtgacctgctgcagctgctgccagccaggcagggagagctgagagctgagcttgccctgtgcccaggagggtggactctggcaggacatggcccggaggaaggggcccgtccgcccagggtgtctgttctaaggagcgcagggacagggcctccccctgcaggcgaggccaccagagtgggccacctcctcctccctgacccctcctcccaaggggcttatcctcctctgcagggctggtgttactcccccgaaggtcaacggggatcctct

SEQ ID NO: 394046 - DNA, 107 bp, Homo sapiens
tagaaagcaagttttaggacagcagggacctagaacagtagtccatacacaatagaggagcaagactacctgggtccaaatcctaactctgccacttgccagctgtg

SEQ ID NO: 394047 - DNA, 427 bp, Homo sapiens
agcaaagcactgtgggaccaactgaccagaggtgagtcaaggggtcaaagcttcagagctgacaactgagtccaggggacatcaccaagcagcggcaggaataagatcagaggcaaatgggggttcatccaccagtgcttcagctacgcaagtgggaagggctccagcatggtcctagatgacggaggaattaaattatcttcttccatgtccacccctatagtcagggtttactgagtgtttactagggccaggtactcttctaagcacttcattaaaactcaattctcacaactactctgtgaagtaggtactcttaccaccaaacatattttgtataagagcaaattcaagcctagaaaaattcagttatttgcccacagtcacgaagcaagcacagtcccagcagtttgacttgatagccccc

SEQ ID NO: 394048 - DNA, 1099 bp, Homo sapiens
ccagcccattcactccttagaacctagttatgtttttgatccagttgatttcatctactagttcacaaaatagtttgaggctgagacattacggtgaagtaatgtaattggaagtgttaaaccaacttttgaaacaacttaatacctgacatttgtatataacatacattgtctcacctaatcctcacaacaactctgagttagaccgggctaatttcctaactcctgggaagcagcaaattttttttctttttccccaatttggttcctggaaacggggcaaatggatttggcatcttacaagtgagaatatgacagggtttactgccattgttgggtagtagtagagccagaactgggaccagtcttcttgagttgtgttctatcccatatggcctctgcttctgtcctttttcaggcagaatatctccccatgcttttagacctaggaatctgatctttttgtgtaattgtgctgtcttcttttccaaattagagccaggtggtcagctttaaagctgtgaagatggtggaagctaatgtttctccagatactgctttctgacctagagccctgagtatttttcctatctcccttcctaaccttcttcactgaatttaagttgcagggccatttatggccatctatacactttctctttgcagcagggaatgtcactgtatcccccgtggtagcagtaatttgggcttttattagcaaagaagattatagggtggatgctgctggagtggtaattgcacttcagaccctgttgaaattcagtaactggaagaatctctttttgagctcagagtcctcttggtgtggaaggttcataggtcattgtacatagtggataagggcaagtacttaagaaatggagatgaaaggggagcacctttttttttaaaataagggtgcttattcaagaaagacctttgagtggcctgttggaatgtagggtgggaatatgagaaagtggcaatgggttttggactgaaaggaagaagagttgataggcgattatgggaacttcgagctggggtaggaggaatttagggaagggaacacgatctttaaacttagggactggattga

SEQ ID NO: 394049 - DNA, 662 bp, Homo sapiens
gagaactaggtgaaatgctgtgctaattaaaaactcctctgtgtgccaaggtattcatgtgctgattctaataatcattgattgcatatatataagggtattttaaagactgcaaccccaaacaaaaaaacacatgggcccctttggacatatatattcatgaggcatatataataagaataataaattcatacttccacaagttgtttttcaaacctaaagggaacttcaatcccttacatctagaactgtttcttaccctagccacgggccagctgactgttgtattgccaaattctgcctcctttgatatatatttggatgggattcaaaatagaaacaaggattcttgtgtgtctattctttgcacttttcacttaggctgctctgctgggtctctttttaaaagatatgattgatccttacagaatgatacttgagaagtagtagtcatctgtcctatttaggcaaataaaagttgctgtaatgtcattaaattgccaaggacaagcctagttatttcagaaatgttcaccctatcccttcggttatccatgcagcataaagtgtcaacatttcttatccatctaaatatgtctgcctcatacaaactgaggacactgattcctttattggtaaaaattccccagtgcttgtcttga

SEQ ID NO: 394050 - DNA, 464 bp, Homo sapiens
caggagaaaaatgaagcagggatgcataaagttagttcagagagagaacaggatacaattttaaatagtgtggtcagataagggtttattaaggaggtggcatttgggccaagacactaaggaagtaagagaacaagctatgtagatagctgggaagagcattcctaggaagagggaacaagtatctaatagagaagcatgtctagtatgttcaaagaatagcaaagccttggtagccttaatgaagaaagcaatggagagagtaataagagatgatgtcagcgagctaaaggagggcatgaagattagagtagggccctataaactggatgaccactgtcaaatgaaattaaggctgttgaggcagaaatgatttgataaaagtttattggaagccaaatgtgaggatgaacccaggaaaacacaccaacaaagttgagagtgttctggagtctgttacaagt

SEQ ID NO: 394051 - DNA, 385 bp, Homo sapiens
gtttttaaattgcacaccattctgaatagcaggatgaaatcgtgcacgtccctcttcgtccctctcaggacagaaattcttttgtccagcatatatctatgttgcatataccaccagccaattagtcacttagtagctggtgttggttatgagatcaactgtcatagtatcacagtgcttgtttcaggtaacccttatgttatttaatagtggcccaagagtgcaagagtactgttgctgacaatttggattcacgagaagctgtaaagtgcttcccttaagggaaaagacgaaagttctcgactttaggaaagaaaaaatctcttatgcagaggttgctaaaatctgtggtaagaatgaattatctgtgacgttgtgaagaagg

SEQ ID NO: 394052 - DNA, 180 bp, Homo sapiens
  misc_feature (47)..(47): n is a, c, g, or t
  misc_feature (70)..(70): n is a, c, g, or t
aaagaacggcctgtacaccaggtactgggccctctgcgtgggtgggnggccaggcccagcagtgcccggntgggggccaggcccagcagtgcccaggtggggagaatgctggggaaggccatagagcagggagtgcccacctggccataccttgtcctgggaaacaccattcaagcccca

SEQ ID NO: 394053 - DNA, 146 bp, Homo sapiens
tatattatatacaaggatattaagggggaataagtaataaactaagatcttaggaaacggaaatgcagttggtacatattagacaaatagaataaaaattaagggaccgttagtaggaatcacaatacacaaaatgcctcattcat

SEQ ID NO: 394054 - DNA, 360 bp, Homo sapiens
tggacagggcttcatgagtgtgcatcctgggaatgcatggatgaatggatggatgaaggatggatggatggataaataatggatggatagatgaatgaatgatggatgaatgaggtgggtagatgaatgaatgatggatgaatggatgatgggtggattgatgaatgaatgatggatgaatgggtgatgggtggactcacctggtctgacctgactggacttcctggactggactgactgggtgcgactggcctacctgacctgctggactgacaggctggactgactgggtgcactgtcccacctggactgcctgacctggactactgcggtggactgacacggaatggactgacttga

SEQ ID NO: 394055 - DNA, 219 bp, Homo sapiens
gtctcccctactgccctaccccagccacctctgccccaagatggaaagcactgcagacaggagtgtgatatgtaagatgctcaccagccatacagccaggcctgaccaaacagaaccgaaggtctgtgcacagtgctggccctgagcctctgagcaccagcccagctgcagccttgtgcttatttccaaaacaaaccagtagatctttgaggaccctgg

SEQ ID NO: 394056 - DNA, 228 bp, Homo sapiens
ctcctagaattggccagaagccaatatctggaggccaaaattgggtcactagggtgaccaactcatcacagggccctggattatctctgcaaaagcccacctgctactggttagccaggaccatcacagtgtgcccaggtaaccctgcgtttcaccccaaagcagaattttacaccagagcctggacaccagttgaattttctttaactcatttctgtcaatggttac

SEQ ID NO: 394057 - DNA, 330 bp, Homo sapiens
ggtgaagcctactgatgacaaatacacacataatatgtaacaaatacacacatactgtataacaaatacatgctatataactaatacatacatacatatatacatacatacatacatatttgagacaggatctcagtctgttgcccaggctggagtacagtggcgtgatcacagttcactgcagccttgaccttctgggctcaagcaatcctcctgcctcagcctcccgtgtagctgggaccattggcatgtgccaccatgctgtgctaattttttaaatttttgtagagacggtgtctcagtttgttgcccaggctggtcttgaacttc

SEQ ID NO: 394058 - DNA, 276 bp, Homo sapiens
ttaagtcctaactcagtgcctcaccataagtataattaaaggaatgtgtacatgggaggatatatttgaaactatttcaaatctatttcctcagcctgagtcttgcagcccagggggctcctccactgcagtagtcccatgctggggacaaaggtggatcctgttgaggcaagtcgctccccggctcccaacatcagttagacttttgtttgagtttccagcaaacaagcaggctgaaaagctatgctctgtctggagggaagattttctaaattc

SEQ ID NO: 394059 - DNA, 279 bp, Homo sapiens
tgtttctttctctgccctgtgggaagcactgtgacaaaatggaacacattagatttgaaggcggggggatcaaaccacgattttgaattgaaactcagctctctctatatgaccctggaaaacatcacatcacaccacagagcgccattttcctcaccgaaagtgaagtgagaatatcagctctgctctataacaacactactactaaaagctcatgcttattcttattgagctattctgtgccaagaatcagtctcttgtatagacaaaggctacaac

SEQ ID NO: 394060 - DNA, 320 bp, Homo sapiens
gaccgtaggcacatctgtgctatttcagcacaaacattgcctggaaggagagattcctgcctgtctcttctgtgctttcagaattgttatgtttcatccttagggcagtgtgagggcactgaagagatcctagtttatcttgcaaatatccccctccctgctgttctttcctaatgcctataaaagcccttaggagctttccttacatgaaaattaagactagttcacttgagtattttattacttatcttctcccttagttcacttgagtattttattacttatcttctccctctatgttcattgcagcctttttaatt

SEQ ID NO: 394061 - DNA, 346 bp, Homo sapiens
tctgctagttcacaagatgctacaggtgggatacgatgccatattcccattctaccctctactctctttccaccttttttgtttttgagacggagtttcactcttgtcacccaggtgacaatggtgcaatctcggctcactgcaacctccacctcccgggttcaagtgattctcctgcctcagcctcccaagtagctgggattacaggcactcgccaccatgctcagctaatttctgtattttagtagagatgaggtttcaccatgttggccaggctggtctcaaactcctggcttcaggtgatctatccacctcggcctcccaaagtgttgggattacaggcatg

SEQ ID NO: 394062 - DNA, 511 bp, Homo sapiens
tggtcatccacggaggacacctgggatgctgggtcccactcctgggacactgctatctctaatcagctgggcagctcctgacttcctctgcttttcaaggtattgccgagacctcctctgtggcttttttttggcagacatgaggatcagcccttgctacatttctaacgccctactgtttgccagcaacagctgccctgctgcatacctcccctcacacaggtgtggcccactctgcccccgtgttaatcctaatcatgtttcatttaaaaatccaggggtctagtttaattttcatcctcatcaatttcctggtagtatctgacattaccaatactccctccccctgaaactcatcattcctctaactggtcttcttagccttcaataaaaaactatttaccatgtagctgcggaatatctggccttgtgctgggagctgtatacaaaggtgagggaggggtggggaaggcctgggatcactaatgtggctctgatgtgaggcacgtca

SEQ ID NO: 394063 - DNA, 4265 bp, Homo sapiens
actcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaattatgccatacaacagtgcccaccactgcgttgtggaggtggaaaacttcttgttcgtgttgggtggagaggaccagtggaatccgaatggaaaacacagtacaaattttgtcagccgatatgatcctcgatttaatagctggattcaacttccacccatgcaggaaagaagagccagtttctatgcatgtcggttggacaagcatttatacgtaattggtggaaggaatgaaactggctacttgtccagcgtggagtgctataacctagaaacgaatgaatggcgctatgtgtcctctttgccacagcctctggcggctcatgcgggagcagtgcacaatgggaaaatatacatttcagggggtgtacacaatggagaatatgtcccatggctatattgctatgacccagtaatggatgtctgggctcgaaaacaagatatgaacacaaaacgtgcaattcacactttggctgtaatgaatgatcgcttgtatgcaattggaggaaatcatttgaaaggtttctcccaccttgatgtaatgcttgtggaatgctatgacccaaaaggtgaccagtggaatatactccaaactcccattttggagggtcgaagtggccctggctgtgcagtgcttgatgacagcatttaccttgtgggaggctacagctggagtatgggggcctacaagtcatctacaatatgctattgtccagagaaaggaacctggacagaactcgaaggagatgtagcagaaccgttggcaggccctgcctgtgtgacagttattctgccctcttgtgtaccatacaacaaataacaccaggaaactctggaatgaacagtatcacattctaggaagcaatggcaggtgacatcactattataataggaacaatgcattctaatggtacaactgccaaaacccacccttggtttctgatgatttataagtaactacaaaagaaagagacctgttcttgaacagatactatgtctataactcagatcgcaccaaacttcctgtggtgacagactcttccatttcagactggttttaacttatcccagctttacaaaaactcttcatgtgaatcttaacttgcaaaaggagaaagataaaatacagaagactggccccagagagacctcagatcagtattgtgcattgtagtctacctgcatgtgatctatgttgacatttcggggatattgtgttcaagaatgattccaaatttgagccaccaaaatacactgcattacagaaattgccacttgattctgtactcttaacctttggctacttcacagactccattggcaacactgttattgaaaatcatgtaagattaaagagaggcattttcgtttctatacaacttcatttcatacaccttctgcccttacagcacctcatgggatcagaaaagagaaagatgttggctcttgtaataaatgctttctaccctataggttctaggctagacagagtcgtcatttctgtgtcctcaattttatctgaaagattaaaacaaaatatattatgtcactattcagttcatggaggtttgtgctttttcatattttgtgatatataagtagtgaacacacatgttatttacttcaaaagacaggattgacaaattcagtcaatactattttagagattctgttagatgatatgtctgacccaaatttaatccataataaaaaaaaatgggagattgttttcaggaattcagggatgaaaagaaagaataatttccattaagtagaattccagttgtctttctgtttctaaaacacagaacttacaagagccacaggagccaattatagcacctgacagaatacttctcctcttcctcaccttcgggtgcctctagacacttgacttacgatcgttattcccccaattcatcatattttgtttgttatcaccagagatgcctgaactcagttaagcgagcaattgctagttgtcttgaggagcatgaggaattcaggagcagaaggtcaggatagcatgagatagtctcaatgtggccaaccaaaaggacaaaactgacaggaatgcacattcgattttcaagccctccagagcttgaacaacaactttaggagtaaataaaagcctaaaatatattttaaccatccagagatggtgttgaatccttcaacaaatgtgtcattcaaaacagtaattagggaaatcccacagatgaaaaatgccttagtgataagctttcatggcagagcacgtcaagataaatgggtatactggaatccgatgccgtttctacagtaaagtgcaatcttcgttgtttttgtatttatttgtatgttcagatccaaaggatccgttgtaaaaatatatatatataaatatatgtatatccagtgcaatcaactgtcatttctttttccttaaaacatatgagtatatagaaagaaaagttacagtactctgtgggaaaatctcagctgacatcatgaatagaatgaggtctgcttcagaaccttttgttgtcaactgtcactgtttcttccaaaagtcacaatttgtacaagaacctttgctttccttagacttgttctgcattttattttttatttctcaccaaaataaaagcatttatgagaattataagtaaagctttctgtatttcagagagacataagttactagaaagtgaaaagtgaataaataagtcacagagaatgtaaattttgtacagtattagaatgtgtaaatgaagcttgcttggaaggggaaaactttaaataaaaactttatgtactaaaaaaaa

SEQ ID NO: 394064 - DNA, 2163 bp, Homo sapiens
  misc_feature (2141)..(2141): n is a, c, g, or t
actcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaattatgccatacaacagtgcccaccactgcgttgtggaggtggaaaacttcttgttcgtgttgggtggagaggaccagtggaatccgaatggaaaacacagtacaaattttgtcagccgatatgatcctcgatttaatagctggattcaacttccacccatgcaggaaagaagagccagtttctatgcatgtcggttggacaagcatttatacgtaattggtggaaggaatgaaactggctacttgtccagcgtggagtgctataacctagaaacgaatgaatggcgctatgtgtcctctttgccacagcctctggcggctcatgcgggagcagtgcacaatgggaaaatatacatttcagggggtgtacacaatggagaatatgtcccatggctatattgctatgacccagtaatggatgtctgggctcgaaaacaagatatgaacacaaaacgtgcaattcacactttggctgtaatgaatgatcgcttgtatgcaattggaggaaatcatttgaaaggtttctcccaccttgatgtaatgcttgtggaatgctatgacccaaaaggtgaccagtggaatatactccaaactcccattttggagggtcgaagtggccctggctgtgcagtgcttgatgacagcatttacctttttttattctacatctttattattttttccnacaattcatctacaatattcta

SEQ ID NO: 394065 - DNA, 223 bp, Homo sapiens
gtgtgactgaggggtgtgtgtatgagtgtgactgaggggtgtgaatgagtgtgactgaggggtgtgaatgagtggctgaggggtgtgtgaatgagtgtggctgaggggtgtgaatgagtgtgactgaagtgcgtgtgaatgtgtgtgacgggggaccacagagggactcggtccttgtgtggctcttcctttacctccatgtctggaagaaattaggacttcg

SEQ ID NO: 394066 - DNA, 721 bp, Homo sapiens
cattgattatttcttctgtgagagtaatgatgattggatttggttaggactgtgggggtgaagcttccttgacttttcatttctgttcacagtacatacagatctgtaaaatttccatggaaatgttcatcaaagcatttgaagcccatgtcctattcgtgcatttgtgtaccctctgtaccacacacctcccaagttttaacaaataatataagtgaaattctcacagagaatcatgctgatttgtagaagttattgcgttactaggatcaccgaagtctgagcatagacatttaggtgaggagagaccctagttaaataccagccctgactaagtaggagctggatgaagcgggaaaggaacttgtctgcgttttctcttggtttttatggggattacacactatctttcctgaagcattcttaaccattgtgaggggctggttaattttaattattagcaaatctaaacacaatttaaaatatcatcaaccaagaaaacccacaaaacagactgaactgttctgtgggttttcctgcttttacttatttattttcaaaacagggtcttgctctgttacccaggctggaatgcagtggtgctagctagcatagctcactgcagcctcgacctcccaggttcgagtgatcctcccatctcagcctccagagtacctgggaccacaggcgtgtgccaccacacccagctaatttttttttt

SEQ ID NO: 394067 - DNA, 191 bp, Homo sapiens
gctggaattggagaggtcctgggaggtaggtgtatgagcacagacctgctcccacatgcagaggatcaacagaccaaggctttttatttgctacctatagaaatatcagtatcttccccagggatttcttggttcaccttcctgaagcagcatcatgattactttctacccgccagctgggcagaacagtt

SEQ ID NO: 394068 - DNA, 526 bp, Homo sapiens
ggcagacgagggtcatctgaagtcggtttaactgagtcattgagtcaggtttctgcccattagtttatctcatttttaaatgagaaataggtgattataataatgcctacctctaagcttattaaaaggattaagttattttatgaatatcaagtactgagtgtaaagccctatatgttttttgtttgtttgttttagttgatattgaccacactaactttatttttgtatctcatgctgtgctctaaggagcacttattagaaagtctgtgctgaaagatatggagatgagtctgattccatacttcttgaaactttttaggaatcatacataccagactgattatgtcaaaagaaaaaatagtagaatgggagtattcagggaacatcctgtctggtaggacctggaaggggtatatttgattgaaagatgattattgaaactgggattttgatgatttaggaaggaaaatgggtataaggtagaaatgtcttttatttatgtattttcccctggtatactatc

SEQ ID NO: 394069 - DNA, 668 bp, Homo sapiens
gagctcggcacccattcatttgcaggagggattactggtgtcagccactgcgccaggcctgtttttttctttagatggtcattggtagctcatgaatatttggctgtagtgccaagtgaatacaggtgttttggatgtggtttgtgtctgtatagttacatcatttctttctctggattgggctctttggatgttacacattataagagtatagacatcgaatcatttggagatctgttttggtcacatagtctgtttgttacctttatattgtagccctcagaatgctgaaagcaaagcaaagttgcatgtctaggcaacctaggccctggaaatgaaggcaggtgttcctggcctctggtgtgtcttcataatgttaggggtggtagagaatggagctagaaagaatctactctttactatgtcttactcttcagggttcattccagcccttgaagtcggtaactaagtcctaaaatgttgggattgtgcaaggaaggcaggggcctggattggtacatgatacctcactgggacctcctcccaaacgcagtggttacatacagccagaactcagcagcaccggcatttatgagaggtgtaagaatgtgaggataaaggattgtttgatctgattcttcagaggaattacttgtcgtttggagatt

SEQ ID NO: 394070 - DNA, 594 bp, Homo sapiens
tgaagtaataccctggtaagaatctaaatgaaggagagaagttaaatggatttctcaatcttgagaagttctctctgatgcagagaatagggaattctatgacaaaggaggacaggcaattaaagagggtggggctggtggcagttctcattcccccatggacatctctgctaagtttttttgggggagaaggaaggatactaagagaaaggagaggtaaaaactcctacatcagctctcagtagccttaggagatctatccaatggtgaaaaaagaaaactggctctgcacaaagaatatgatttgtgacaaatgtgaaggcagaggtgttaagaagggagcaggatcctgctgtgccaactgctgaggtgcttgaatgcaaacagtaattcatcaataagacctggaatggttcagcaaattcaatctgtgtgcatggagtgccaagcccatggggaaaccatccgtcctaaagatagacgtgacagctgcaatggaaggaagacagttgcagagaaggagattctagaagtccatattgacaaaggcatgaaagatggccagaagataacattccgtggtgaaggatacca

SEQ ID NO: 394071 - DNA, 416 bp, Homo sapiens
ccagttgagcatttctaattggcaagtccaaaatgcttcagtgagcattttctttgagcatcatgcaagcactcaaaaagtcccagattttcgagcacttcggagtggggatgctcaccttgtatctgttctgccatatgagttattttaaagtgggcaccaaactgggttggacttttcaaaatttggtgattttgtagctgttaagccagctatgatttgagatttataatgatagtcattaaactcagataatattactttaacactagctcctggataattgcctgtatcatagtattatcacatggattctttccagtgagtaagtatatagaaagtagatgaagaaagcatactaaccatctagaaaagagtgtcattgtaacgttaatttgctgactcactttctaaag

SEQ ID NO: 394072 - DNA, 708 bp, Homo sapiens
atgtggaaatcgcggtgatgggaactggaaatgaaataggttctttttcgcagttgtttttctgcagaaaatcatcaactgtggagaagaagaagggaaataagaaagaaagaaaaccctaaaaaccaccctggcgcccgggcccgcaggcctcgggccggctctgaaaagtttgggctgtgcacgtgatgagcgcgtaggcgggagccccagacaggacccgggcgggcatttcgagaaaaagcagcggtgacagcctttggtccccatctccattgttcctgccagctctggaccccaggctgcatgagacgtaggtcccaggggacacccgaccccgtggccccagtcttaggtaaacttaggaatcagaacaacactcacccctatgccgcgcttgctccatttccccttgtctatttctgctcaccaagcatccagctgacattgcattcaaagcagcatttcagcttagaaatcgcttctagtccatcacggtgcttgccatgtgtctccaaggctttattaggtgtgtttttagttgtcctgataatcagttcaccccagggtgctgatggctgataatactggcgcttccctccctacccccatgcgttgcacagggagggtgagtcatgtggagatggatgcagccccctgggcagtgggggtgcaggtgctgtgcagggaggagtcttagggcgtttt

SEQ ID NO: 394073 - DNA, 338 bp, Homo sapiens
tttaatgtgtggcccaagataatttctccttccagtgtggcccacgaaagccaaaagattggacaaccctaggctactctttctagaaaagagaattctaccctttaaggaacttttaagagtagtttcttacttttcccccaagaattctggtcacatatatggttctctcctctgaagtgggactatgactaccagtttgaacaattaaaaatccaaaggggctgggtacagtggctcacgcctgtaatcccagaactttgggaggtcaaggggggaagatcatttgtgcccaagagctcgagacaagcctgggcacacattatgggatctctaca

SEQ ID NO: 394074 - DNA, 396 bp, Homo sapiens
tcctatcattccacccccatgttggtttcctcttttctccatctcagatgcatctcagggcatggactgcccccagcccccaaacatgcacctgagcaaatacagccttgctctgggaagcattactcctagaagagttccagaatttctggagcctaatgtcctggagttccagatttctggaacttgccccactggtgccctgaggctcctgccctactgcttcccagccttcctttctggcttgcactggtttgcttggaggagttatttggtttcctatgtctttctccatcctctcccagactcagctcagaatgcccacaggcttgggtcacatcaaacctgagagaccagcagactcaaatgtggtctctcaagtttgggagggccctg

SEQ ID NO: 394075 - DNA, 300 bp, Homo sapiens
catgaagccgtacagtgtgcagaggaaatagctagaatcgtcacactagagttctgcaggtcactacgtgggggtccttgagtcatccagagatgctgggcagagctgtggcctgagctagtggaaaagcttgattggttggggcagagaaatgtcccacagctctgctcagtgagttgcatctggggacaggggttcttaaggatctcactgtgagtgtggtagaagcaggcactatgctgaggaggccagataaggtggacatcactacctgggcacaccctgcccactctggccctt

SEQ ID NO: 394076 - DNA, 280 bp, Homo sapiens
taatttgggaagattctttttatttaagaaaaaaacttaaaattacataactaacacggtcattgaaaaaagttagaaaatacagataaggagaggaagaaagtcatcattacccataactcttatagctgaccactgttaacagtttgggatatataattctgtacagaattatatgccagatataaaacggattttttaatgagacgagattattctgagtctgctaatatattatgattttatttatatgctaatgaattccacaacaacatgatgc

SEQ ID NO: 394077 - DNA, 177 bp, Homo sapiens
gcttacccattatgtgacttgagttgattgaatactccaaaacaatccattagagtgactaataaacttgatttcctgaggtctattgatgatgtattttagcctatagttttgctaaagactattgggagcctggtctgattcaaatccttctgcaaacccatgacattcacatga

SEQ ID NO: 394078 - DNA, 383 bp, Homo sapiens
  misc_feature (14)..(15): n is a, c, g, or t
  misc_feature (18)..(18): n is a, c, g, or t
ggggaccttatgtnnganccactatgactaatagaagactggctaaataagttctggtgtatccttattataccagaactagtgtatgatacagctatttttaaaaagatgttacagaaatgtatccagtgataggaaacaagggtcagcaaactacagccctttggccaaattggctcaagacctgtttttatactaccagagctgtgagtgggttgttaaattttaaaggattattaaaaataaacgtgagacagagtatgtgactagtaaagcttaaaatatttactatctaaccctctatagaaaatgtttgctgacccctgatatagaatgttgtatacaatgtagattaaattggtaggggtgggtcagaacataag

SEQ ID NO: 394079 - DNA, 467 bp, Homo sapiens
atccagagcaaagggaaaggggaagacaagctccttttctttttaaggaaggtatttgtatcacttttccacacatccagtccccagaacctaggcagaagttggatggccatgtataatgtttagccggatgatcatgtgtccagctgagacttctgttactataggagaaatggagaactattggcatttgtttctgccactggatagtgtctggataaaaaacaaaaatagttataattgctatttttatgtcttaaagtttgtataatttatctcatttattatttctaacagtctggtagttcatgtgattttagagagtccagaattgaagcccagactctatttagcatttaagacagaatgatgtagtaaagggatattgagctttggagtcaaacactctttgatttaaatccggactactaattcaggatatactaatgtgtgaactgagacaaccc

SEQ ID NO: 394080 - DNA, 204 bp, Homo sapiens
acccaaaaagagataaagaagcccacagcctggttgaggcagggaagccatcagtactatcagcatccctccagccatggcccttcctaggtcacagagcctctagggtccccagctgccacactagctctacttaaggtcaacattgtacaagttcaggcccacctagggcataagccaacactgcctaactaaacctccctg

SEQ ID NO: 394081 - DNA, 123 bp, Homo sapiens
gactaaatttaatttttttgtgaggtggcaatgagtttttaaaaaggtgttggcaaattacaaaaaaaaaagcctgagttaagataaagaatagatttagaaaagatattttggaataactat

SEQ ID NO: 394082 - DNA, 575 bp, Homo sapiens
aggcctctacagttatcgggtaagatgtaggtaggtaggtaagacatgacaacacacatggctttgctttcaactaagggcttggttacctgtacagtttctggtgatagcatccattgagaatacacactttgttcagcattgtgctttggggttcaaggataaatttacagtatcatacatgtacttcaggccttcaaaccgcttggggaaatggaaagagcgcacatagcaatagcactaaatatatggcggaagataagccagtgctgaattttgtgggtcaggtgagaaaagttttaaaatgctgagggaggtttcaaaagcaagagagtgcaagagaatttgcagagtttgcagatttgatgggatttagaacagtagaaggagggggcatggatgaggaggtcagctctggaaggctgagtcaggatgaactaagcactaagaagagcctctatcttccccgaaactttaatcacagaactgaaatacaaagagaaataaaaaatcgtttagcccattttttttcttccttagtccaatgcccactgtcagtggagaaggaaagatgc

SEQ ID NO: 394083 - DNA, 566 bp, Homo sapiens
ctgatacaagactcaaattacagagtgactgacataaaaagagaggcaaattgacatcatggaaagatactaactttggagtctgtcatattcactttcaaatctgtgaaaggaaaataccttgggcccccaaaatcactcaggaaaactcaagctggaaactgcttagggcaaacttgcctcccattctattcaaagtcactcttctgctcaataagatagatgcatatctgatttgcttcctttggaaaggctactcagaaactcaaaagtatgtaaccctttgtgtttcacctatttgtgacctgaaagctccctccccacttcctgtcttcttgcttttgcttcatgttgtcccacctttccagactgaaccactgtacttcttacatacattgattgatatctcatgtctccctaaaatgtatgaaaccacactgtgccctgaccacctttggcacatgttgtcaggacctcctgaggctgtgtcatgggcgtgtcctcggccttggcaaaataaacttcctaaattaccggaaaaaaaataaatcggctccgtggcctca

SEQ ID NO: 394084 - DNA, 715 bp, Homo sapiens
cagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacatt

SEQ ID NO: 394085 - DNA, 697 bp, Homo sapiens
gcagtctgttctagaaagattcccatggctaaaatatagacagtttggatccttaccagaatattatacacagaaaagttccccttttacagaccctgttgccaggggagtagatggcagctttttctcccctcctacctctacagcacagacagtgtccttccctttcaaacactccctgatggggatgctctgtcctctctgtggaccaggcctagtaggttcacagatctcttacaaactgctcaggggaaggaaagttgagggaaatcatccgtgtagattttttttttcttcatgtgcatccattcaacctattaaattgctttttattttctcttaaaagttgattttattttctgattttagttattgtgaaaaagggcagccagcgcagtagctcacgcctgtaatcccagcactttgggaggccgagacgagtggatcacctgaggtcaggagttggagaccagcctggccaacattatgaaaccctgtctctactaaaaatacagaaattagctgggcgtgatggcaggcgcctgaaatcccagctactcaggaggctgagacaggagaattgcttgaacgtgggaggcggaggttgcagtgagccaagatcgtgccactgtactccagcctgggagacagagcgagactctgtctcaaaaaaaaaaaaagaaagaaagaaagaaaa

SEQ ID NO: 394086 - DNA, 198 bp, Homo sapiens
ctgttaagaagttcaatagcattatgtctagaaaaaaaagtacataccttaattttaaaatcctgctaaaaatgttgtgatcatttgaggactcagcaagttggaacctttctgttgtgtagggccttgccttgatgttgatgggctgctgcctggggtggtttactactaggtgctattgaaacttctaaaactagg

SEQ ID NO: 394087 - DNA, 843 bp, Homo sapiens
gctctttttccagctggaaccatggagtgtgtagaagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaaggcttcaaagaggcaaataacttcctgtggcccttcaaattgtcttctccacgaggtggaatgaagaaaaagaccacccatttgtagaaggtggagatgctggcaacagggaggaccagatcaacaggcttattagaagaatgaactaaggtgtctaccatgattatttttctaagctggtcgggtaataaacagtacctgctctcaaaaaaaaaaaaaaaaaaaaa

SEQ ID NO: 394088 - DNA, 583 bp, Homo sapiens
ctccagcacagacaccagagtggtgtcaaaaaaaaaaaaaatatagaagatgcgatgcatatagatatacaactattttttcacactacagactagactatataactatttcttaaacttacaaaaacagcaacctatattcagtgtgcacattaacacactctgtgccttgtttttttcttatggcaagtatgttggctattgtttttctgtcttggtggctttgaggccatgtactgtgattttgcatagcatgttaaggtttagcagttgatggttaatttatttgtgtatgatgtgtgtctgcaatatggaaattaaaagctgactgtaacaataaattatgaaaatgaaaaagtaggcaataaaataggcatgtgctttgcaagttctatagcattatattgtatttcttgtaaaactgcactaccttgaggttgctttctagaagtaatgttattgtttagtatcagcattcactttttttagaatcacattgatagatatgatgtaaatatttgcacaggtgaaattaaaatacacagtaaagaggatagttcgaaatcttaagagagggatatat

SEQ ID NO: 394089 - DNA, 472 bp, Homo sapiens
tctggggactctgagtaaatggccacccaggccaatcgcttttccttattttggttttgaaattcttttaaactttggggtgatgtcaacattggtaaactgtgtataagtggcttggcaggtcccaagaaacaactgcagctcaagcaacatattagaacaggtttcctgggtctgttttgatatcagtgaaagaaacccttaatacagtgacatttacattaagactgtgctgagcaaggatctgcctttttaaaaaaaaaaacttctatgggcaagagggatgtgatttgcttgcttttcttgctgaactttaagccttaagggcactatacaacattggatgcatgacttttaaaatcaaccaatgagtagttacttaggaccccccagaggcccaacactgggctgtccagataccaacacagatgaaaccacagcacatagcacaaagcacaaagtacaatatgat

SEQ ID NO: 394090 - DNA, 225 bp, Homo sapiens
ccttccaagtgtatttctagcttgtctattcccaccacctatccccaaaatggtaagcactggtttccaaaatacctccttacccctacttgaaccaagactacattcacaacaaatataacacaattagtcatagcaaaaaatattatatactgataacattagcatattacaaattcagaaaatggaaaaatgataagtgtgtttattctgctaaattatata

SEQ ID NO: 394091 - DNA, 271 bp, Homo sapiens
accataacagatgggaggttatgacgtagttgtcacctctggttgacatgtaatgaaccaggacctgcaggcaggtgagaggttgcagcagggctgtgaagggaagcttccctgaagctgatcgacaaacactggagtaaccctgaagtagccggtaggtttcgccttgtggttatagtggctgtctggatgaagtggctgcaactgtgtcatgatagttagtaatgtctgctgtggacagaaatgagaatgatggctcaactggcatgta

SEQ ID NO: 394092 - DNA, 967 bp, Homo sapiens
cgaaactcggtctcaaaaaataaaaaaataaagaaaacatttttcatggacccatctccccgcaagatgttaacctgaatcatttttatcatatcacttaggtaaaacataaaactgggtatatatataaaaaaaaaaccacttctttttgcttttgttcttatacctaaccttaaaatcaaactgtttccaaagtagataaatgtaaaaaccgtgacattccacctgactgtgttaactgaaaatggtgggtggtgctttgctgactgcactgcaggatgtggtgtggcaaaggcacagactcagcagagtagatctggatggtcttaggccccgatgctcctactggtgatgaaaatggaaacccaaagccaaacatccttctagagaactggcgaacccctcaaggtgacacatccacaggtcccacctggagaaatgtaaatgtaaggaaaggaaactgggcatcccctggagggaggggacccgtggtggccacctgctctagagtcatgccgagagttaagagcagtggggaccacccagccctccttgatggaaactgaccatgaatcccatgtcagccccagctgcacacctgtctggtaactcctcccagttagttcattgccctcagctcatttggtcaattaccagctcctgtacaaataccccttaaatatttcagggttttggcttctttcctaccctcatctaaaccatcattatctgatcacaatcatttatcactccccaacttaaaacccttcaggccaggcatggtggttcgtgcctgtaattccagcactttgggaggctgaggcaggcagttcgcttgaggccaggccaggtgttttgaggccagcctggttaacatggttaacttcttcaatactaaaaatacaaaaatagccgggcatggtggtacatgcctgtaacccctgctactcaggaggctaaggtacaa

SEQ ID NO: 394093 - DNA, 345 bp, Homo sapiens
tctgctagagatttcttgcagatgatcacgagacagaatattgagttctgctagcagtgtgagaacttaactgatagagtaaacattaacttatgctgttaaaattaaactagaagaccccaaattaattagacataggggtggcattgcttttcagggacaattaataattctgttcttatttctcttttgccatttttcatgatgatcgttttctaaattcccttcattaaaaagatttcacattgattacatatcccccaaagtaacttgttttaagagaagcaaaattacacgatctgaaagaaactatgctatttcaaaagtttatacatgatcacatgg

SEQ ID NO: 394094 - DNA, 416 bp, Homo sapiens
atggtagattccaagcagatgccctgcaaggccagcttaaaaggacgcgaaattcatgtagactcagttgcacgacttgcacacattatcaaacatctaaagtccttataaagagatcatctctaacagtgatttgatatgactttaagtcactttccacataattaacaggtagaaatcagttttctcatagataatattaaatagcagatgaaagataaaatctcccaattaatatatcagtcatgatgctttagatggcaataaccgaaaaccccaactcaagtacgacgagaaagtgaattcacatattatctggtatcctagaacagattagtatttggcatgctaagctccaggtgcgcaagatctaaatgactcaatgatgcatttatggactctggttccactttcag

SEQ ID NO: 394095 - DNA, 567 bp, Homo sapiens
agaatcctgcccactcagaacccaagacccatgcctggggctgcctctggccaggaagctctctctcctcagcccatccccagccttctcctcctggcccagctcccccttcccttgctgagtttctagcacctcttatgctgttcacacccagacaattccgaaaacactggatcccctgtgaatggtgtggaaatgcaacttccccacgtggagtcgctgggcatgttccccttcccttcccctcgaaccctgcacagagggggccattatgtcacacaaggccacttcacgagtaagggacaaaacagcccttttgaaactcaaaacaaagcttaagagccgcacctgagttactaaagcttccactcagcctcacccattcctagcaataagctgcagcagccggatctgctcccacctctgggtgacggctgggaacaccaggctgttacctttcatcaaaaacacaaagggacagcaagggacctcaggcatgtaatggcgccgaggagtagccataacatgttattacagaattagttctttcgaaactgcgtgccaact

SEQ ID NO: 394096 - DNA, 821 bp, Homo sapiens
ctgcaatatgccaggcactaatcatcagtgaacaaagcaaatcttgccctcaaggaacttctgtgtattgggccttctttcttttttattgagacaaatattccattttatggatatgctacactgtccatccaacagctgatggatacttgaattgtttccagtttaggactattataaataatggagctataaatgttcatgtgtaagtcatggtgtggacatatatttcatatctcttgagcacatgcctaggagtagaattactgggttatctgaaaagcatgtctttactttttaagacattgcctgttttccaaatttaccatttaggtataccattttacattcctaccaacagtgtattccaatttctccacattttcaccaacacttgttattgtcaggttttttactgcagccatcctaggtgtgtagttatatcacttgcattttcctaattactaatgctattgaacatttttccatattatggaatattacttggcaataaaaagggaacatgctacaacatgatgaatctcaaaaaaatgctaagtaaaagaaaaaccaaacccaaaagaccacatattatatgtttttatttctatggcaggtccagaaaaggcaaaattatagagatagaaagtaaatcattggctgcttggagctaggatgggagtgggaatgactgggcacacgggaactttttgaggtggtggaaatgttttaaaattgctttgtgatgatggctacacaactctatgtttactaaaaaatgaactatagggctgggtgtggtggctcacacctgtaatccc

SEQ ID NO: 394097 - DNA, 100 bp, Homo sapiens
gaactccatgatgactatcaggggtttaatggcgacctgaggttctgaccttctcaactaagtataaagaaagaaaatgcagaaggaaagaagttgaatt

SEQ ID NO: 394098 - DNA, 177 bp, Homo sapiens
tagcctgaggcccccgcatggcgggcatccccaccagacgttggcggacgagagccctgctgacgccagccccttcccccaccacacccaccacacttcccggtccgacgcaggactacctgttcccgggcagacacagagcacagagtgccgggtcccacgtcagcccctgacgca

SEQ ID NO: 394099 - DNA, 797 bp, Homo sapiens
atgtatgcaatgtgtaatgatctaagcagagtaattagcatactcatcacctcaaacatttattatttgtgttaataatattcaaaaatgttcttttctagctttttgaaaatacataataagtatatttaaccatattcatcctacattgctgaagaacaccagaactcattcctcctatctagctataatttcatattcattaaccaacctctccccatgctccccacccctttccatatgatccagcagtccttctactgggtatttatccaaggaaaaagaaatcagtatatcaaagagttgcctgcaccaccatgttcattgcaacactattcacaatagctaagatatagaaccaaactaaccgtgtatcaatagatgaatggataaagaaaatgtggcatatatacacaatggaatactattcagccataaaaaagaatggaatcatgtctttggcagcaaaatggatcagcctggaaataaaagtcaggcatggaaagataaataccacatgctttcaaagaagagcagagacagacagacaaatggccagagggagatagacaggcgaatataaagataggaatggacagaggtggataaaggcagggatagacagacagggaaggatagaccaagaaggagagacagagccagtcagatggaaaaacagaaaggcagaggcaaacatggatagataaaggtatagagatcaactggttaatatagagagatggaagcatacaaagagagatggacagacaaagagaagcagacaggtggaaaggaag

SEQ ID NO: 394100 - DNA, 338 bp, Homo sapiens
ctgggtttgaaaatcaacataaaattggaagttcaacagttttttttctttttaatggggaaatgtgtttggaggcaggcacagaaatgtttgctgactgtgtcatatgaaccactgtaagtgacaaaaaggtgtggtagtcttaggctgcattaacaaatgtacaatttccagatcacaggaaattaaagtctcactacactcaaaactggccacactatatctggagaactagatgagttctttattaacacactttaagaaggacattgataaatcagagcgcatcccataatgagaaaggggtccagttctggggaccatggtcaagaagttcc

SEQ ID NO: 394101 - DNA, 547 bp, Homo sapiens
ataattatcaaaatatgacacagagacacaagtttataggtgagcagatgctgttggaaaaatggcatacagaattgcttgacacaggattgccagaaattttcaatttgtaaaaaaatgctttatctatgaagcacaataaaacaaggtatgcctttatattcagaatcttttggcaatgagatattctggataatttttgtgtttgtggtaacttacagagtaatgctattacaaattcaagataatttgggtatgagtagtaatgagtacctcataggcagttggagtcacatgtatgagcagatattacactgaatgttaatgggaaacgttttggtcagtcagatctctttagattcaggaaaaatagaatgaatttataaatatataaggagtacatgctttgggaatactgaaattggtgaattggtaaaggaaatcagagaagaatatgttaatgaataggaagattgaatatttgaatgatgtcaagtggtccccagattgttctacattatcaattaaatcccatcaaattctagca

SEQ ID NO: 394102 - DNA, 371 bp, Homo sapiens
ccaagaccctcagcgcccgtcccaggccctaggaacctgccaggccagcatgagccagcctcggggcgtgctccgcagaagctctaaactggaccccgcagacccacagatcagaccctggcccccaaggggcaggcatgactcccagaagccttccctgcaggctggagtttggggacttccagcacagcacaacctaggtgccgtgagacatggaggcggctcaccgccctcccagggccggccggggtccaccggatacatcttcccacacggggtgaacaaggagcctcccctgtctcctgcagtggtgtcacctggtccccgtccctgtggtagccagcagtccagacagccagagcgggagggag

SEQ ID NO: 394103 - DNA, 527 bp, Homo sapiens
cagctactcgggaagctgagtcagaagaatcacttgaacccaggaggcggaggttgtggtgagccgagatcgcaccactgcactccagtctgggcgacagggtaagactctgtttcaaaaacaaattatctatctatctatctatctacacattaaaaataattcagtggtaccccaaaaagctaaaagaaatactttgataaaagaattctactcctaggtttatatccaaaagaactgaatacaggaacttgagcagataatgatatgccagtgttcactgaagcattattcacaacagccaaaaggtgtatgacccaagtgtatatcaacagatgaatggattaaacagccagaaaagaaagtcttgatacttgttacaatacagttgaaagctgaaagcatcatgctaagtgaaataaggcagacatgaaaggccaaatgttgtcacactactgacatgaaatattcacaacagtcaaaactcacagagacaaactagataaggggttaccataggctggcag

SEQ ID NO: 394104 - DNA, 195 bp, Homo sapiens
aaaatcaggctgtattgagagggaagtaagtgggaagtgaaaagtgtgtcaaggctgagacaagcagaagttcagctcctttgctgtcattgctgtggctgtatctcctcttcttgcccagtcttttcactacaggctgtgctatatgcgcacacatgcacgtagcattagaaaacctgaaaaaggggtgactgt

SEQ ID NO: 394105 - DNA, 385 bp, Homo sapiens
  misc_feature (6)..(6): n is a, c, g, or t
agaggnatttagaatgattgcctttgatttttttatttaaattcaagatccaatcagggctctcacattgcatttgattatcctttctccttattttcctttaatctagagtatttttcttgtctttttgttcacaaaagagaaaaagcaagagaagtttagaccagtctaggctggcctacagtctggatttcttttttttaattgcttcctcattactagattcaacttacatattttagggcaagattactatataggtaataatgtgttcttccttttatatcacatcgggagacacataatgtcagtttgtcccattattggtgatgctgactgatcacttggctagaatggtacctaccagatttcttcattataatgg

SEQ ID NO: 394106 - DNA, 699 bp, Homo sapiens
cttagatcgagctctgtacccaatggtctgtcggttggatgcagtggctcatggcgtaatcccagcactctgggaggctgaggcaggcggatcatttgaggccgaacgaaaggctgaggcaggcaggagaatggcatgaacccggaaggcggaacttgcggtgagctgagatcgcgccactgcactccagcctgggcaacaaagcaagactctgtctcagaaaaaaaagtaggaatgggtttgttcatggaactgtttgctctgggaatccattttggctaaatattagatgcgagtgggggaataataggaaatatagctgtgaacataatttgaatctagggcagaagggtctttaaaagttcatctaaagaatttggacataattctgcagagaattttccaaaagagtgttgttatttgagctacatgtttaggaacgtgaatgaagaatggcgtgttactagaaagactggaggtggcaggaatctatttgaaggccattaaatagttcataggtaaggtaattagaccttgggttatgcctactcatcctttaaaatttaccttaagcttttcctgccacaccttttccttgcccaggttaggtgaaatcttcctccttgatgttttcatactattatgtgcctagtggtatcactgtacttatcctccattgtgttctttttgtgtatcttt

SEQ ID NO: 394107 - DNA, 284 bp, Homo sapiens
catccatccatccatccactcatccaaccatttacacaccaacccatccactggcccactgatccatccaaccatttactcaccaacccgtctaccagcccactcatccatccatccactcatccaaccatttacccaccagcccatccaccagcccacccatccatccatccatccatccactcatccaaccatttacccaccaacccatctaccagcccactcatccatccatccatccacttatccaaccatttacccaccaacccatctaccagcccact

SEQ ID NO: 394108 - DNA, 756 bp, Homo sapiens
caccacatatattattgcattacatatatcattgcatacagtcaagtagaaaattctagaattctggatctcagatttttttccaattatataatgagattaatgaataggaagaaagtgtctattactgcttttctttttagcgtcatcttaaacttttctaaaattatcattaattattgtttatcctttcactgaccattgccctaaatatagtatctgtcacttacatgtatttcaaaatattgtttttggttattctgtaatgctgatttaaagagatgcaaattattttccataaagtacctctgtattctcctttttggagctttcttatatctgttgcctgttaaatgtctggccacttgtggcactttccttctctatctttctcaatgtaatattaaattaccatagcaattataaaatcatgcagaataataaatgtgtggtacaaagtcattgatacaaatactagaaaagaaaatgaggtttaggcctaaaggcattatgtgatgtaaataaggaatactagttacaataacaaatgtatcatcatataccatattgtcatcatagccattattatcaccatacatcttttaaatgcaaacagaagaaaggatgaatttgttaatgcagtggaacacaaaattgttttattatttggatatattaatgatttggcaagaaaaaataaatttgacatttctattgattacatagctgttaaaaatgagagtcatgaatagggaa

SEQ ID NO: 394109 - DNA, 347 bp, Homo sapiens
gctgcattctcctctccaggaagtacatttgtgggctgctaagccacaagataaggaagaacacaagacagctagagaaggccacgagctggacccaatacccacatattcaggagtaaacactggtgctgtgaaagggtcagtgcctccataaacgtctccacagacatagagctctgagcggacacggaccactacacacaacagagctacacacaacagagcttgacaagccacagagctccacaaaccgcagagctctctacagacacagacatctcctcaccacagagctttccaaaccaaagagctctccacatacacagagctctccacaccacagatct

SEQ ID NO: 394110 - DNA, 130 bp, Homo sapiens
gttacaaagttactcctcaggccgaagtaaacgttcaagttaatcagaatgagggcagcctcaggaacagccaaaaataccctgctggcagctgtcttctctttgcagctaccaaggtttttacctactg

SEQ ID NO: 394111 - DNA, 404 bp, Homo sapiens
ggctgaggcaggcggatcagctgagtcaggagttcgagaccagccatggccaacatggtgaaaccctgtctctactaaaaatacaaaaattagctgggcatggtagtgcaagcctgtaatcccagctactcgggaggctgaggcaggagaattgcttgaacctgggaggcggaggttgcagtgagctgagatcacaccattggactccagtgtgggcaacaagagtgaaactccatctcaagagaagagaagagaagagaagagaaaagagaagagaaagaaaaagaagaacaaagttggagaactcagctttctctattttaaaactaattacaaagcaatagttatcaagacagtgtggtcctggcataaggatcaatggatccttgacatattgatgaatg

SEQ ID NO: 394112 - DNA, 224 bp, Homo sapiens
agaattcaaagttagatgtgaaattattatatcaagaaagactgagaagtaactcaagaatgccaccatcttctgaaaactgtgagattactcatatcacagatatcgtaaaacatgaagttatttaagttagaaagtagcttatatgcaaagtaagccagcaattcaattagaaagttaattttttacctctagacaagaaaagtttcttgtttcagatgatg

SEQ ID NO: 394113 - DNA, 280 bp, Homo sapiens
ccaatctacagctttctaaagggagtcacttgagaaaatgtcttaaggcaaaaaaaaaaaaaaaaaaaaaaaatcccatgggaggaataaatgtatgtgtcttctataaaaaaagtttccatcgttgttactttgtggtcaccttgacaagaacagtaaccacaagcattcatttcattctttacataattttattaacttcaggcatgatgtatataagctgcaactatctatttaagcagatctccaaaaataaaaaataacacatataccctttcac

SEQ ID NO: 394114 - DNA, 452 bp, Homo sapiens
aagacagtgactttggaatcagccagattcagctaaactctatgttttgctgaaaggtagctgtgtggtcttgggcaaataagttaacctctctgagccacggttgcttttctgtaaaaaggagggtcagactgtctgtgtcaggttgttctgaggattaaaagagatgacataggtggagagacacctcaatgtgcagtgcttgtcggttatctgttagataatacagatagtatcgtagatattagctaataccaatgagatctgtttgctaggatgttcttcaaatgcgactggagatctgtttgctaggatgttcttcaaatgcatattctgattcggttgctctagagctgggcctgagatgctgcatctttaacaaacccccagatgatgccgatgctgctggccccagaccacactctgaatagtgagatgtgacattgaccttg

SEQ ID NO: 394115 - DNA, 306 bp, Homo sapiens
aggaaatctacaaaaatatttgtggatttagaaacactaaagggaagagaaaattgttctgtagttcacgttcctgacatttcagaagctcatgatcccaggctctcaggttacaaaaagatttttttcttctaaacatgttcccttaaggtgtcaatggttgataatgcgcccaataaacattaatgcatcaaacaagtacaaaccctttttgacacaggaacagagctgaaactgtgggaccttaagcattagcaggcatgggtgtgttttggagagggaaaagtcctcctgagatcacatggg

SEQ ID NO: 394116 - DNA, 490 bp, Homo sapiens
aacccagctgagtggagctcgattgacaggcaagtgtttggtgtccccctggcttgtagaagggccgatgttagctcctgagaccaccatgtgtctactgcgaaaggacagctggacacctgcaagcctcctacagataggggaaggagggaatggggagaaggggaaaatcagtaaaatacgaccttttccagcacctgggagagaaggtgctcttgcaccaagagccagacactgctctcctgggggagggggccatctttcccggcttcatccctctccctggcctgggagggaggaggagacccccactgggccattccaggcaggtgctcagccagtgggcaccctggtcaagcaagcctgggtgctccaaggtgaaaggaaccttaaacccattggactaggaccccaaccttcttaccaccctcatccagggacccttgttttgaaaacttctatatattaaataaatggcaattaaaacaga

SEQ ID NO: 394117 - DNA, 621 bp, Homo sapiens
tgcttgtcaatcacttcctgctgtgcggcctggttcctaataggccactcaccagtactggtacccggcctgggggttggggacccctgatttagactataaatcagaagatgtcataatacaaataggtctatgtttttggtcccaagaacaaagttaacattctaaaatggaaacaattaaaaactgagcaaacaaaatgtaaattttccagcaggatgattttttgacaactggatacattacaaacgcatcccctcaagatatcccacctccaccccaagaggtagacactataatgacttctaattctgtaattaattttgcttatactaggagttcatataaatggaatcatgcagaacacactcccttgtgcctatgagattcactcatgttatcgagctattcggtagtagttccttataactataccttaattcctccattttcttttcgatggacattcgggttatttccagtttggaggtttcgtataataaaaatgctattaataagaatgttatgaatgtttttgttcaaattttgagaacttaagttatttttctgggtaaatacaaggaagtgctgggtcacagagtagttctgtagttaacttca

SEQ ID NO: 394118 - DNA, 369 bp, Homo sapiens
gatgatgcccggttacctggcatttcacaaagtaaagatgcagccagtattcatctactttaatctataatatcgtccctttgacatgctctagtcatgcacgtggtatctgaaacctctgctcttcctagaggaagtcctggtttgcaaagagttctatcaataatgcatcctgactgcaaagcagagacatttgagtctgcacttaaaagacttaaaaatgttgccagtttttctgcattttaatgtttactaaaggaaatgtgagaagtgaagatggactattgaaaatgcttgacgttcttcagttgttctttatgtttcaattttagcttgccgatgccattttttatggggctttaaaaatgc

SEQ ID NO: 394119 - DNA, 381 bp, Homo sapiens
ccccacgtcagggaagaagggggaatccagccttcctgtggatgagcccagagacccagcagcccagggtgacacagctgcctcatgtcccaatcgcagggccaaaaaataaaaacctcaaatccaccaaaaccgtggaccatcacatggcaaagcgccccagtctctgctaaacagaagaaagggagagcaatcatcagaattggtccccatcaaatccagtgatgctttttattgtctctagtgtgctctgttctggagagcaggcttccaaaatgccactgctttctgcaagagtggggcaggggaggggtggcgaaggctgggccaagtcccagcagcaagcatgggagcctatagacttgaatctggaggcaaagc

SEQ ID NO: 394120 - DNA, 421 bp, Homo sapiens
aaatggaatggagagtatagagttcccactgtacccccgtcctcacacgcaagtgcacagcctcccccaccatcaacatcccacgccacatgggtggtacatttgttacaattggtgagtctacgctggcacatcattgtcacccagggcccacagttcacatgagggttcactcctggtggtgtacagtctgtggatttggacagacatgtaaggacacgcattcaccatttttgtatcatacagaatagccgcttcactgccctgaaagtcctttgtgctctgccctttcatcaccccagcacattttatatgaagcatcactgccctggacagtgatttgaggggatcagtggtgtttggctcttttgggattggagaaggagaatttaagcaaggcaggtttggattagaaagggct

SEQ ID NO: 394121 - DNA, 349 bp, Homo sapiens
aagtagttttcatccatcagacttgcaaaaatgaaaattctgaaaaattaataaataaagtatttggaagaatacatagaaatgacccacacactgctggtgggagttctaattatttcagccaatacaagcgtaatctgatagaatctaactaaaatgcacataagctatgacctaacgatttgacttgtagacacacaaaccctaaagaatctctcatacatgctcaaggggacttccacaaggatgttcactatagcactgttaataacagcagaatattgaatacaacctaaaactgggtaataaatacatagaatattttttattcacagggtggaatactgta

SEQ ID NO: 394122 - DNA, 306 bp, Homo sapiens
aagctactctgtgtgcccctggattctgggccagggaagccctgtccatctagtgaggacgacaacaccactgccagctgcagatctaagcatggcttctcgctgtaaaggtagctaattcaatccagtgtaattggaaagatcgtgcctagattgacttgtgtacccttcagtggcagcaggggattgattcaaatgaccttggatgcgaatcagctctacaaaagtggcctcttgtagctggtttctgccccttcctggctattcaatgataaccagtcttccgtcttatctctttaccttgcc

SEQ ID NO: 394123 - DNA, 535 bp, Homo sapiens
caaatactgaaagacttgtaaatggctttggcaatatgtttgaattctaagaggaaatattttcccataattgtatatcagagaaatatagtgatatacaatttccttgaaaaccaatttctaaataattttcttctctgtaatctaagtgtaaaaaggtttagttttttaataggtttaggtgtttataagcaatagttctctattttctagttgatataagtagaagaattgacaagtgagatggaaatgttaatttataaagggaaagaaaagctaggtgaggttgagttataattaaactgttcaggaaacatcgtaaaggctttaggctccctttttcatttctataccaattaatctcatgggttctagagtggttagttctacgggaattgtttttgtttttgtttttaaagatgctgaaaactactctcaatcaaattagtaccatcatttaagctttgaatacttggcagtaattgcctgggctcgtcaataaatgttagcaaattcttgatgttcctcacttttg

SEQ ID NO: 394124 - DNA, 406 bp, Homo sapiens
ggaaagaactgcctatctccagcgttattgcaagcattaactggagcaaatggcctacagcatgcattcaatcaatgtctgtcagtattattaccagcaaggggccagaaggccccaaaaaatccagactcacttctcagatttcacactaatacatggagactgggcttataggacacaaaaatgactaaataagaggttaaaaaatgtctcctaatcatccagatgtttggtagatggagcacatataacattcctcaggtttctccccaccaatattttaccttcctcacctccttctggggatattataaatagctaagtgatactgtaaaatgttcacaggggtttctcccctaacacatatgtttacttaaaaatgtaaaacatctgtacagcacaacag

SEQ ID NO: 394125 - DNA, 233 bp, Homo sapiens
catgggtggtgatgggacaacgtcggattctggttacagagagggatgagatcgacatgtggggctaagtttgagggtgtgggttgggttcgaaactaaggctcaaatcaaagctggcagggaagagccgtgaacacaggtgacacagggactccccaagctcctgcttaggtttcccaaacctcagtggttctgactggtacacttcagaagaagtgggattctaggaggag

SEQ ID NO: 394126 - DNA, 731 bp, Homo sapiens
gagatgtaaccagagtgcttcagggaacaagacattgcatcattgcaaaaatgtagttttttatattagagcagattgagaacactggttcatcagggaagtggagaggcaggagaagggactgggaagtgatatgggaaggtactaaagataacatcttccacctttgggctattgcctaaagttacagtgcctagacaacattccttttaacttcagtggaaataaaactggcataaattaaaatcctctcgaataatatagcaagtacattttacttttcagattctgttatgatagctttttgtataatgttgccacagcagaattcagctgtcttgctaactttttcagtgtcttatttcctacttaaattgaattacctattcctgaatttcaaagccatttaaatgtagccttgtccctatctacataaattaatttccctctgtttccaacacacattcttttatagtcaaagcactcctttagcgacaaatatactgacgattttgtcggaatgtttttttccacatatttccttttctcgaagtgccactacctctccttacccaatgccaatccattcttcaaagaggtcttgtagtctttagtgataaatgtgaccttcattaagttccctttccgcccaacatttgatctttatctgtagctccccagacctctcttttaaattgcagaacctccatttgcagctctctatataggat

SEQ ID NO: 394127 - DNA, 784 bp, Homo sapiens
ccgatttctttttcctcctatgttcccagattctggaatggaaccccagcccttccaggtctgagagccactctttctttactctggatttctgtcacatcgggggcccctccctctgcggagttgcatgttgctgttcctgatgcacagactcctcccccgctgcttttctgcccactgggtcaggatctgccattctttacaagtttccttaacgtattgcgtcaaagcgagacaaccgagtcttactcaaacttgttttaaccggagatggagggttgctgctgtgtcaccgcctgcacagggctgccctcagggcaagctttcctggggcttactccaagggcatcggcttgccccgcactgtggtgggatgtaaagtgataacagctaaacgacgcatgcacaacatgtcctggtgccttctgcgtgaccccagagcagcaggttctgcacgtggcaggtaagagcacagctgccaagaccccaagcctagttctgctgctacaagctgctgcgtgacttaaggtgagttcatcttcgcctcagtttcctcctctgtcaaatgggatagtccttaccgtgtatggaatttaaagcactttgaacagtgagtgtgagccattactaactcaagtaataccccttcccaacccagaaccctataaggcagggacagtcagtccctctctctgctttagggggttgcaggataaagacaccgtcacaagaaatttaaacacagtaggtaaattttgagccacagcaaagcacagaggttgca

SEQ ID NO: 394128 - DNA, 348 bp, Homo sapiens
ccgatttctttttcctcctatgttcccagattctggaatggaaccccagcccttccaggtctgagagccactctttctttactctggatttctgtcacatcgggggcccctccctctgcggagttgcatgttgctgttcctgatgcacagactcctcccccgctgcttttctgcccactgggtcaggatctgccattctttacaagtttccttaacgtattgcgtcaaagcgagacaaccgagtcttactcaaacttgttttaaccggagatggagggttgctgctgtgtcaccgcctgcacagggctgccctcaggtgagtaccccgagtctgccaggctgggtgct

SEQ ID NO: 394129 - DNA, 234 bp, Homo sapiens
ggtatatagggggccagttcttagctgtttgggaggcagtgacttttagctgattgaacgaaaacctgagaaaatcacggagagtcaccttagttaagggaaaagtagatggaagtatctatttgctgccatgatagtatcaatacagaggtcacaataaggtcacagagatacttgcaagttagaactggcagagtctcattagtctactgtttcctgtttggataggatgtg

SEQ ID NO: 394130 - DNA, 586 bp, Homo sapiens
gctgggggtgttgcggaggtgtaggtctgcagtgagtgcccgcatgtctctgcaggcgggaccacatactggccattctggcgctgcgccgactgggccgccagcggaaccagcatctcttgcagcacaccgaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcggggggggcctcccgcccgactgtccagcttcaccctccagtctgaaagtgaagagcagagtatttatttaaaaaataaatgtgaattaaaatgg

SEQ ID NO: 394131 - DNA, 2355 bp, Homo sapiens
  misc_feature (12)..(12): n is a, c, g, or t
  misc_feature (16)..(16): n is a, c, g, or t
  misc_feature (840)..(840): n is a, c, g, or t
gagcgcggaggnggangcccacccttctccccccgacgacggcgacttcctgcgcacgccgcgccgctggcgccagcactgggaggaggcggtgcggcgaagcgctcaggagcgcgtgcggcggccgggcgcggggtgggccttcggggaggcggagggcgcgtcgggtttggcccagcttctggccgagctgggtggcttggttcgccgcgacctgcagaaggtgcggcaggaggtgcagcccgcgtatgcggcggccggcttcccagcgtgggaggtctatctgcgtgccttccacagcgccgtggcccagcgcctccaggagctcgcgcgcgacgcccgcggctgcgagcagctctatatcctgctggactgggccgccaacgtctacggcagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgccgaggtccccgaggtgctgcagggcctctaccaggcgccgctgtccatggacgtccatatggtgcggcccgggagcaggggctgagaaggggcgtctgttcaagcctcacgcacacggtggcgatttccagaacgaattcctatccagtcccaaccaacccttccgttagatgggagcctgaggccccacgcggggggaaatcggggacccccggcgcgccgacgggcagggaggctgctggatgggagtttgcgggagttgactctccngttgggcggctgaaagctggaggggccaagactgacaggcacagcggggcgggctggaggcgcagcgggggctaccaggggacccgcggcctcaggtcgggggctgggaggcacgctcagtgcggggcttcgctcgcagctcgtggccgagcacgtgaaggcggccggcgccatctccgcggagctggaggccaccaccctgcgaatctgcacgcgggcgctcggcctcttcgtgcccaggtgcggacgcatcctcagtaggggagcgacctggccgggtgcgctctgcaggtgggagggaggagtctgcgtagggacctgattgggagggtggacccagggtcatcgcgcagctagggagggtccccaaaggctctgtgtatcccgccccaggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacaccgaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcggggggggcctcccgcccgactgtccagcttcaccctccagtctgaaagtgaagagcagagtatttatttaaaaaataaatgtgaattaaaatgg

SEQ ID NO: 394132 - DNA, 658 bp, Homo sapiens
ttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccaacaggcatccactggggcagcgtctgaggaactgaaacccgaggcagaaggcaaatccgtggccgacctcattactgaacggcaactgctggcggccttcgaacagcttctgcgcctggagacgctgctggtggccgagaaggcctcgcgcacctttgagcaggaccctacggccttcgcgcggcgcgctatggacgtgtgcctgctttacgacgggctggcagccgagatcggcgccatcgtgcgcgagacgctggacagcgacggtgtggacgcggccgc

SEQ ID NO: 394133 - DNA, 1780 bp, Homo sapiens
ttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccaacaggcatccactggggcagcgtctgaggaactgaaacccgaggcagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgccgaggtccccgaggtgctgcagggcctctaccaggcgccgctgtccatggacgtccatatggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacaccgaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcggggggggcctcccgcccgactgtccagcttcaccctccagtctgaaagtgaagagcagagtatttatttaaaaaataaatgtgaattaaaatgg

SEQ ID NO: 394134 - DNA, 1881 bp, Homo sapiens
ttcttgcccccagctctcctgctgccaagatgccatcaccacagacagacactcctgggccggagctgcagagtcccaaggaggctgaggagccacagactccagctcagggctcccggcgaacaagcagcaggaaagagcccaatgcccaccgcaaggatggcacaaggctgggcctgggctccctgaggcaggccttctcccgggccagccagcgggctttgacccaggtctccaaggaagatacgggcctgttccggcgaagctcctgctccctgttccggtccttccggcaagccctgaatgacggcccagctaccggccattcccaggccactcctgaggtgccctcgggggtcatgaatggtgtcagccaacaggcatccactggggcagcgtctgaggaactgaaacccgaggcagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgccgaggtccccgaggtgctgcagggcctctaccaggcgccgctgtccatggacgtccatatgctcgtggccgagcacgtgaaggcggccggcgccatctccgcggagctggaggccaccaccctgcgaatctgcacgcgggcgctcggcctcttcgtgcccaggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacaccgaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcggggggggcctcccgcccgactgtccagcttcaccctccagtctgaaagtgaagagcagagtatttatttaaaaaataaatgtgaattaaaatgg

SEQ ID NO: 394135 - DNA, 1847 bp, Homo sapiens
gaggttgcctgaagtcccgcactccttaaattgctccttaaattgtgtggggtcagacccgtgtccgccctgctgtgggcctccgtgctgcgggttggagggtggccgattcctgagctgtgtttgaggagagggcggagtgccatctgggtagccgtccttcagcgttctgcaggaaggcaggaacccagctgtcagaggcttcccgggagggggtgtggcatggcagcctagaggcgcgcgcgcgtgtgtgtgtgtgtgtgtgtgtgtgtgtgtgtacagatgcccaggttcgggattggcgttagactttgagcctggccagaagaggggcagcggctgccgcatcagagccgctcccgcccccagccccctgccctgtcttccagtcctgacttcctgggcgccccggggctggcgctgcccgccgagccgctgcctccgctcctggcgccggacgtgtgggcccgactggagagcgactacaccagcttcctggaggccaagatcgcaagctgcttcgacagcatcttgcagctggagcagagtcactgggcggccgccgaggtccccgaggtgctgcagggcctctaccaggcgccgctgtccatggacgtccatatgctcgtggccgagcacgtgaaggcggccggcgccatctccgcggagctggaggccaccaccctgcgaatctgcacgcgggcgctcggcctcttcgtgcccaggtttgaaaaggcttttctggcgtcggaggcggtgagcgagccgcacctgggcgcctacatcaacgcctgcgaggagctcaggaccagtcttctctccaggttcccaggaacccaagaggagctggagaagcccctggtgacggccacctgcagcttccagaagcacttgcttcagggcttgcagcgtgagttgcagccgctcttcagggttgtgtgcaccagggactggctgacgcaggactggctgcatcccctcatggacaaggtggtgaccttcgccggtcatctccagcgtgtggcccggccgcgggcacaggagactctgcaggaggtgcaccggttcgtggtccgcgagtacctggcgcgggcgctgaggccacgggagcggttccggggcatggagcgcatgcatggctcccagaagatgagcctggatgcccaggccatcagcgacaccttccagggcctgggttccgaggccacatggttggaccaagccatccagtgcgtggctgagatcctgggcgagacctacaaagatgacatccagcggcacctggagactcttatccggagctaccccgacatcaggcgggaccacatactggccattctggcgctgcgccgactgggccgccagcggaaccagcatctcttgcagcacaccgaagacctgctgagagctgcggccggggcggcgggtgcggaggcccctcggggccgcgtgctcttcgaggagatcaaggtgcccagtgccatggctgtgctgatcacctgcgtctagttctctctggctcgagggggggccggccgctggcagggagctgtggtcagtgggggtcagccaggagcccagggagtcactctgggccctgcccccaactctgacactgcagttagggaatttttgtcgtcagcagccaagcgcagctgtcaggccagaaggagcagccgtgcaggaggcatttcaggcatcgttgaggggagtgttttggggccgcagagctctcaatgctgcctatcgggcggggggggcctcccgcccgactgtccagcttcaccctccagtctgaaagtgaagagcagagtatttatttaaaaaataaatgtgaattaaaatgg

SEQ ID NO: 394136 - DNA, 679 bp, Homo sapiens
ctggcggcgttcagaggatcccgacggctcacggaactttatgtcaatgaatgtgaaaacacagatgacttagatgaattcgtagaaaaatacaatgtattatctaaagaataaactgagactctaaataatcctttgacaactaaaaaaaaaattacatcaaaagttaaaaatgctctcacacacacaaaaagcaaccttaataggttatagatgaatttcactatgcattcaagaaacacaattctaatcttatacaaaacttccagagaatagaaaaaacgtatggactcattttttaaaaagggcaattacaggccaatctcacttcctaaacagaaatgcaaaatgccaaaactaaacatctgtaaactaatccagaaagtataaaaaagataacatgacaaagtctgttttggttaaatttaggaaatcatataaatataattcactgcattaacagattaaaagagaaaaaactatacagttatcatctcaataaacacatttaatataactcaatatttgtgcgtgatataaacttttatacaaaaatttgagctgtctaaatataataaaaggcatccacaagaaaaaaagagtaataattaaaggtaacacctggaacgtattccttttatgactggcaacattacaagaaaatgctcattatcagcac

SEQ ID NO: 394137 - DNA, 192 bp, Homo sapiens
acaatgtacactataaaacactatacattacttacaatgtacactactggaataactggtttactaagatctcagaattcaccactacataattcatccctataacaaaaaaatactggtacctcaaaagctactgaaataaaaattaattttcaaattttaaagaagactttttcctcatgatattgattg

SEQ ID NO: 394138 - DNA, 755 bp, Homo sapiens
  misc_feature (120)..(120): n is a, c, g, or t
  misc_feature (552)..(552): n is a, c, g, or t
  misc_feature (669)..(669): n is a, c, g, or t
  misc_feature (674)..(674): n is a, c, g, or t
  misc_feature (676)..(676): n is a, c, g, or t
tgatacagagtctcactctgtcacttaggctggagcgcagtggcatgatctcagctcactgcaacctccgcttcctgggttcaagcaattctcatgcctcagcctcctgagtagctgagnaccacaggtgcgtgccaccacacccagctaattttttgtatttttagtagagacagagtctcaccatgttgcccaggcttgtctccaactcctgagctcaggcaatctgcccaccttggcctcccaaagtgctacaattacaggcacgagccactacacctggcctcatgttttttaaataattgccttttatatttaccctttttgtcatcactttagaatgaaaattcccatttaaatctaaaagttactttaatagtcctcttgtgttattaggacagtgttactatagtacttatttattatattttagactttttcttttttcttctgctgcttttagggacagttaaaactgggaaactatgaaacatggaacattttatcctacctagaatagtaaatgagtaattgtgaagcgtaagacaccgnaggctaatacaactctgtcttcatgtgtcgagtgcctggcacatagtactaattctcttccctttaacatataaatgttaagctgcttagagtctagtaaccaccaactgtaaacgnagccntngtgcctttaacaagaaattttaaactacctatgagtatttctttatagggctcacttaaatacgtttgtatatactgta

SEQ ID NO: 394139 - DNA, 326 bp, Homo sapiens
gatagaccacagtagactttgacccatgtatccttgatgagtggcgagagtttcaccacattctgtattggaaaaccccctgatgactgcaaccacagtctatccatatgctgtagccatggcctatccacatgctgtaaccatggtttatctaaacactgtaaccatgctttatccacaaaacgtaaccacggtctatccacacactgtaaccacggcccatccacacgctgtgaccacggcccatccacacgctgtgaccacggcccatccacacgctgtgaccacggcccatccacacgctgtaaccacggcccatccacacg

SEQ ID NO: 394140 - DNA, 311 bp, Homo sapiens
ctccactcgagcatgcggcattatttaatcactgatagttcttctgtgagaccgtctttgacagctttcccctgacatctttctcttgtgaacctctgtggtgttgaactctgcaccccaatcaagccagaggtctctcacatcccctcccatgggtcgttgagctagaactccagcctcggggctgccctgccctcccccagttgtctcagacacaaacactcgagaactctgtgaccttctctgctcctccccactgcccaggcaccagcaggttctgcagcttctaacacccaccccgtcccctctac

SEQ ID NO: 394141 - DNA, 354 bp, Homo sapiens
  misc_feature (1)..(1): n is a, c, g, or t
  misc_feature (24)..(24): n is a, c, g, or t
nctagtagtcgtacagtgtccagnaggcaaaaggacaagtatgcaccgccctacttacctactttccacactgctgcacaggaaaatctgacagaggacaataacaaacatctcaccagctcatgcgttcttttttgatcctaattccgagagactcaccaaagacatgaagagaaaacaaacaatacttttcttggaaatattgtaattgctggtacgtttgttgttctggcataaagtagaaattgtcaggtaaacattgcttccttttggatcaaaaagaaatttaaccaaataaatgcaagaggtatgagggaagataatgggaaataaatgagatttgagaaatcaaaa

SEQ ID NO: 394142 - DNA, 378 bp, Homo sapiens
atcgagctcgctaccttgacattcgtgtcccatatcacgcgtttattcactgctctcagagataaatccggaagttaacagcagcccctgggtctcagcccccaaaacctcaggattaatttgggaaaatggggtcttctgccaccagcctacagacctacaggaaggaagcgaggcctgtgttctatggagcccctcgtggctaatcttcctgctaggagtgcccttctcatggggccagcatggggcagcgcttcccaatgctctttggacccagggaaatggcatctatactgccctgccctatggcggtgaaataggttctcgcttcctgctgctgagattccctgctctccggcccaccagcacaccgggtgg

SEQ ID NO: 394143 - DNA, 375 bp, Homo sapiens
tgggaggatcactgagcccatgaaggtttagcctgcagtgagccgtgatcatgccactgcactgcagcccaggcagcagagtgacagcaacaacaacagtaccacacagactctggactaaaactgctcaggtttagctcatacttctgcagcctactagccatgttagctgtgtgactttggagactttccttagttgatccctcctctgtaaagtgagggtgatactagtacccacctcataggatagctataataattgagcaaattagcaatctatgtaattaataatagatattaatatatggagttaatagtgtatataaagggctcagaagaatgcttagcacctaataagtaccatcaaaatgttgt

SEQ ID NO: 394144 - DNA, 624 bp, Homo sapiens
catttctcctttatttcctttgtctgtagaataaagtcttagaataatattcctgttaaggccctgcttatcccaataccgtatccatactgaactttcagttctttatatgcactctactctctgtctttcagatttttgcaggtattcctttagaacactctttctcttccatcttatcgcctactctttgggtttctgtttaaacattacatttctcggtgggggggcttttctgtcccttagagtaggtcacacctagcagctgtatgttttcaaagctccatgtacattttttatcatgatactcatcatttatcacttctcatttttgcttgtcttcctggtagactaaaactgcatgagaacagagatcttatgtttactgttgaaacacctgtactagtatattgcctagtatatagtatgtggtcaataaatatgccttgaaggagtaagcagcatagtggtcatgtaagcaaggagttggaagggttcattaagagtagagttgaggtatgattggtaagtgaggaagtagagggaatgtagcctgctctctgaagcagcttagctatgacaggaaagagaaatgaggcacacaaatgtttcttcttgtttcag

SEQ ID NO: 394145 - DNA, 498 bp, Homo sapiens
tggagtcaaagaggattgtcctgaggcctccaggtctcaggcgctttgccttgctagacgtgtgacttgcttgggacccgtctcccctctcttcctactgggtcctgccttttgcaatggggagttccatcccatgcctgttcactgttgtattttagaaggacgtggcttgtctggtctcacaggttcttggctggagagcaggtctgctttaggagaaattgtaccttgagtcttacccatttctgatttagatggtagttaaatgaaactttggcttagactttagagttgatgctggaatgggttaagacgtttggggctgttgggatggagttaatgtattttgcatgtgaggacataaattttggaggcaaggattgaatgttataagctgaatgtttgtgtcccctaaaactcatatgttgaagccctagcccctagtttggctgtatttggagaaggggcctctaaggaagttaagtttaaggttaaatg

SEQ ID NO: 394146 - DNA, 399 bp, Homo sapiens
cattactagtgaagatgttctagttgacctataattatctgccctttccaagaccactgattcagaggaagcctagtagagacagacctctctgaattctcaatgaagtctgaggtggcagagtttgcaaaatgaattagaccaggctggagactcatgttttgtcatgggaagagaggcatgtgctacgtggagagggactaaagagaagacaagtaaaggaaacccaaagataattgggagaaaggtgagagtaagggagggagagggcatttcctgacattctctgtattattcccttcttgcattgccataaataagtacctgagactaggtaatttataaagaaaagaggtttaattggcttatggtcctgcagactgtacaggaagcacagca

SEQ ID NO: 394147 - DNA, 260 bp, Homo sapiens
cccgagtgccgctagaggcccggctaattttttgatttttcatagagaaggggcttcatcatcttgccaggctgctcttacactcctgggctcaagcagtcctcctgcggtggccttccaaagtgctaagattgcaggcgtgagccaccgtgctggcctcatatttggttctattccttgttaaatgatggtctgccctccagtggcctttgtcaccttcacctgaaggttatgctcagctggagagtctgtgcctctag

SEQ ID NO: 394148 - DNA, 597 bp, Homo sapiens
gtctaccaatactgtatctacttgaaggcttagttcccatctcaccccctccgtgggatctttgaggactgctccattcacacaagtccctccctctgaatcccatcatacctatagcatgtgctgctcattcattcagaaaaaaattttattgtgcactaaatatatacctgccagtgttagaggagctgaggatacagcaatgacaaaatactgctgtctttgtgggaaggcaaaaatgccggtcctttaaagctgaagttctagtctatcattggtacatattaaaaatggttccaaacactggttaaatttttgtgtatatcatttgtctctgcaagtaaattgtatatttttttaaagcagagacttattctgtggttacagttttgggatttttcttttttgttgttgttgttgttgttttgttttgtttttggtaccctgtgctttgaataatatgtcttctgaatagtaggagctttttaaacatttcagaatttgagaacagaagcgttctcaaatcctgccaataatacattcattggcagttatttttagtggtgcccgatctggataggtgatgattgccactgt

SEQ ID NO: 394149 - DNA, 153 bp, Homo sapiens
gcatccaccttccagccactccaaatacaatgtgcttgtatatcattgacatcctctgtttcccattgtgtgtctcatccttatatgacctcagttgcaatcttcttcagaacttatctattaattaatgtattcatccattaatattgattg

SEQ ID NO: 394150 - DNA, 470 bp, Homo sapiens
acatcttaacaccttattgaatgaaattttaattatgagacctactgaaaacccaccacaaactaacttccacccctctccccagcctcattttctactctcccttcacacgggccggcttccagagaggatcccaaatgctcttgcctctgaactctgattctctgccccaccttgctgcagtacctcacctcctcacctcccagcccagtggggtccagcctgggctgcacattaaatttgcctggaatgctttaaaaagtgcagatacaggccgggcacggtggctcatgcctgtaatcccagcactttgggaggctgagggcaggggcagatcacctgaggtcaggaggttgagaccagcctggccaacagggtgaaacctcgtctctactaaaaatgcaaaaattagccaggtgtggtggtgcgtgcctgtaatcccacctacttgggaggctgaggcagaagaa

SEQ ID NO: 394151 - DNA, 319 bp, Homo sapiens
catctccatttccagtgggagaattcaggcctaagccaattagtgcagagcatcctgccagctgtagggattagttcagaaatgagcgtacgttttgaataaaaaaggtgcaaggggaaattttctggggcttctgcagatattgtcctctctctctggagaaagcatcagcaggagccagtttgatcctctgacattgctgtgtgtggatatgagttctggggatactgcagccacctcacaagaagcttgtgcgtgacactggtgcagcggtgggaatggccaggagcatcacagagaccactggataaagccaatc

SEQ ID NO: 394152 - DNA, 1455 bp, Homo sapiens
  misc_feature (8)..(8): n is a, c, g, or t
ttttgcancccgtcggccaggcgcacgcccatcttgccccctcctggtacaggagcaggttgtgcagcgtggtgatggcatagaacaggaccgactccacaggggagctgagcatgcggaccagagcagggatgccacccgacttgaagatggcgagcagcccctcccggtggtgggagaggttgtgcaggatgctggtggtgcagcgggctgtgtccaggtcgctggtattctgcatggtacgcacgacagcggccaccagctggggcgagcccatcagggcccgccgcgacgcctccttcttcgacagctggttcacaatcatggccgccttggtcaccaccaccgggtcctcgtcgttgagcagtttggtgagctcgggcagggcgcgagtggccagctcggcatcgtcctggtagttgatgagatgcacaatggccgacttgagcagctgggacggctcggccagtcgctgcaggttggtggcctgcccctccacctgggtggccagcagaagcgagctgtcctcgcctgacacaccagggcacatggcctcccgcacccgtttggccctggctgttgtggacatctggtactccaggtcaccttggctggggggcaccccctgggtgtaagtggtggttttcttgagcgtgtactggcgcccgcaggcctcatcctcctccatgatgcccttgctgctgacggagggcacgcaggtgttggcgcccgagtggatacccgagtcgtaggtgtatgtctgctgccactcagtcaccttgataggctgctccatcaggttcatcacctccatcgtgcctccgctgaagaagccagagccgggctcccaccggcgtggagggaggcgccgcaggtagtatcgacgaggctctgggagctggagggcagggcctctggactccgtgcgctcacctgctcggcaggtggggccagagtcgctgggaaaatgtgcgctcggcccccacagttgggcaagctgggcgcaaacaatagggccccacccaggcctgggggagtagggagggagggaaagcgaggatgacgcgtggggtggggtgagggtggccccaaagagaccagcggcagcaagttccccaaacggtaaattcctgactgcagcgtgagccctgggacgcagtcgaagcagagcaaagtctcccccgccagcccagggcgagagtcagggacgcggcgtcgggcgagctgcgcgggccccgggggaggcgcgaccccggaggcacctgtccggatccctccccgccttgctcagatctctggttcgcggagctccgaggcgcgctcggcccgaaccgcgcgacccccaagtcgccgcgcccaggaccccagcgcgccccctgccgccggtgcagggtggcgctcgatggcaccggccctcacctgcccagggacggctgggaccggccccgcggccgc

SEQ ID NO: 394153 - DNA, 469 bp, Homo sapiens
ttgccaggctggagtgcagtggcacgatcttggctcactgcaatctctgcgtcacgggtttaagtgattctcctgcctcagcctcctgagtagctgggactacaggcatgcaccaccacacccggctaatttttgtatttttagtagagacggggtttcaccatgttggccaggatggtctcaatctcctgacctcgtaatccacccacgttgttctcccaaagtgctgggattacaaggtgtgagccaccgcgcccggcccaaacatattcttatacaattctcttcttagatatagggtttgcaaacattttatctcacattgtaattattttttcattttcttgaaagtctactttgatacaggaatatttgtgaattttataaagtacagcttatctgtattttctattatacttgtggttttggtatgatatccataaaatcattgcctaacccaaggtcacaa

SEQ ID NO: 394154 - DNA, 532 bp, Homo sapiens
ctctgcatctactctgacccctagccacaaccttctccacattcaagccatgacatgacaagcgctcacgtcaaagttcaaatctgatcatgacacttccttgcttaaaacattcagtggcttccagtcgttattagaataaaaacaactattcatgccgcctacaaggttctcctcactgtggcctggcctctccctcccgccccttaaacctctggccttgtactctctgctccagggaccacggcttcctctaggcttctcttctttatcctgcaccctcttcccacagggactttgcatatgctattctttccatttaacatcaccttccctcttctctttatctcatttaaactacacatgattcaagatttcggaaagtcttaatttatctctctgaatggggcaaaagacttattacatgttttcaatgcaatattcacttgtcttcagagtctagcaattaacaattatccttttctccctctggacctgagaggaggaggtggaaacagtgggggtgggaggg

SEQ ID NO: 394155 - DNA, 169 bp, Homo sapiens
gcagaaggaacaaaacaggaccgctgcctccttcaccagcctggatttgactcccagctttgtccagagagggaattggtcctgaagaaacagtcagaggtgagcactgagatgtatgatgcagggtgctcactgtaacactgtttccaagaatgaaacatccgaagga

SEQ ID NO: 394156 - DNA, 3900 bp, Homo sapiens
  misc_feature (439)..(439): n is a, c, g, or t
  misc_feature (473)..(473): n is a, c, g, or t
  misc_feature (1789)..(1789): n is a, c, g, or t
  misc_feature (3111)..(3112): n is a, c, g, or t
  misc_feature (3224)..(3224): n is a, c, g, or t
caagagcttggcgatacagaaatttctgctggtgttggggcgggtgcgggaactgaagacgggcgagtgcgagccgggggcgggtgctggggaagggtaagcgggaagcgagggcgaggggtaggggctggggaagggcgagcgggaggcgcgggctctctctagcagggggctgcagccatgaagaggctcttagctgccgctggcaagggcgtgcggggcccggagcccccgaaccccttcagcgaacgggtctacactgagaaggactacgggaccatctacttcggggatctagggaagatccatacagctgcctcccggggccaagtccagaagctggagaagatgacagtagggaagaagcccgtcaacctgaacaaaagagatatgaagaagaggactgctctacactgggcctgtgtcaatggccatgcanaagtagtaacatttctggtagacagaaagtgccngcttaatgtccttgatggcgaagggaggacacctctgatgaaggctctacaatgcgagagggaagctttgtgcaaatattctcatagatgctggtgctgatctaaattatgtagatgtgtatggcaacacggctctccattatgccgtttatagtgagaatttattaatggtggcaacactgctgtcctatggtgcagtcatcgaggtgcaaaacaaggctagcctcacaccccttttactggccatacagaaaagaagcaagcaaactgtggaatttttactaacaaaaaatgcaaatgcaaacgcatttaatgagtctaaatgcacagccctcatgcttgccatatgtgaaggctcatcagagatagtcggcatgcttcttcagcaaaatgttgacgtctttgctgaagacatacatggaataactgcagaacgttatgctgctgctcgtggagttaattacattcatcaacaacttttggaacatatacgaaaattacctaaaaatcctcaaaataccaatccagaaggaacatctacaggaacacctgatgaggctgcacccttggcggaaagaacacctgacacggctgaaagcttgctggaaaaaacacctgacgaggctgcacgcttggtggagggaacgtctgccaaaattcaatgtctggggaaagcaacatctggaaagtttgaacagtcaacagaagaaacacctaggaaaattttgaggcctacaaaagaaacatctgagaaattttcatggccagcaaaagaaagatctaggaagatcacatgggaggaaaaagaaacatctgtaaagactgaatgcgtggcaggagtaacacctaataaaactgaagttttggaaaaaggaacatctaatatgattgcatgtcctacaaaagaaacatctacaaaagcaagtacaaatgtggatgtgagttctgtagagcctatattcagtctttttggcacacggactattgaaaattcacagtgtacaaaagttgaggaagactttaatcttgctaccaagattatctctaagagtgctgcacagaattatacgtgtttacctgatgctacatatcaaaaagatatcaaaacaataaatcacaaaatagaagatcagatgttcccatcagaatccaaacgagaggaagatgaagaatattcttgggattctgggagtctctttgagagttctgcaaagactcaagtgtgtatacctgagtctatgtatcagaaagtaatggagataaatagagaagtagaagagcttcctgagaagccatctgccttcaagcctgccgtngaaatgcaaaagactgttccaaataaagcctttgaattgaagaatgaacaaacattgagagcagctcagatgttcccatcagaatccaaacaaaaggacgatgaagaaaattcttgggattctgagagtccctgtgagacggtttcacagaaggatgtgtatttacccaaagctacacatcaaaaagaattcgataccttaagtggaaaattagaagagtctcctgttaaagatggtcttctgaagcctacctgtggaaggaaagtttctcttccaaataaagccttagaattaaaggacagagaaacattcaaagcagagtctcctgataaagatggtcttctgaagcctacctgtggaaggaaagtttctcttccaaataaagccttagaattaaaggacagagaaacactcaaagcagagtctcctgataatgatggtcttctgaagcctacctgtggaaggaaagtttctcttccaaataaagctttagaattgaaggacagagaaacattcaaagcagctcagatgttcccatcagaatccaaacaaaaggatgatgaagaaaattcttgggattttgagagtttccttgagactctcttacagaatgatgtgtgtttacccaaggctacacatcaaaaagaattcgataccttaagtggaaaattagaagagtctcctgataaagatggtcttctgaagcctacctgtggaatgaaaatttctcttccaaataaagccttagaattgaaggacagagaaacattcaaagcagaggatgtgagttctgtagagtccacattcagtctttttggcaaaccgactactgaaaattcacagtctacaaaagttgaggaagactttaatcttactaccaaggagggagcaacaaagacagtaactggacaacaggaacgtgatattggcattattgaacgagctccacaagatcaaacaaataagatgcccacatcagaattaggaagaaaagaagatacaaaatcaacttcagattctgagattatctctgtgagtgatacacagaattatgagtgtttacctgaggctacatatcaaaaagaaataaagacaacaaatggcaaaatagaagagtctcctgaaaagccttctcactttgagcctgccactgaaatgcaaaactctgttccaaataaaggcttagaatggaagaataaacaaacattgagagcagattcaactaccctatcaaaaatcttggatgcacttccttcttgtgaaagaggaagggaacttaaaaaagataactgtgaacaaattacagcaaaaatggaacaaannaaaaataagttttgtgtactacaaaaggaactgtcagaagcgaaagaaataaaatcacagttagagaaccaaaaagctaaatgggaacaagagctctgcagtgtgagattgnctttaaatcaagaagaagagaagagaagaaatgtcgatatattaaaagaaaaaattagacccgaagagcaacttaggaaaaagttagaagtgaaacaacaacttgaacagactctcagaatacaagatatagaattgaaaagtgtaacaagtaatttgaatcaggtttctcacactcatgaaagtgaaaatgatctctttcatgaaaattgcatgttgaaaaaggaaattgccatgctaaaactggaagtagccacactgaaacatcaacaccaggtgaaggaaaataaatactttgaggacattaagattttacaagaaaagaatgctgaacttcaaatgaccctaaaactgaaacagaaaacagtaacaaaaagggcatctcagtatagagagcagcttaaagttctgacggcagagaacacgatgctgacttctaaattgaaggaaaaacaagacaaagaaatactggagacagaaattgaatcacaccatcctagactggcttctgctttacaagaccatgatcaaagtgtcacatcaagaaaaaaccaagaacttgctttccacagtgcaggagatgctcctttgcaaggaataatgaatgttgatgtgagtaatacaatatataacaatgaggtgctccatcaaccactttatgaagctcaaaggaaatc

SEQ ID NO: 394157 - DNA, 355 bp, Homo sapiens
caatatcatatgccacttcctgatgaatgtttagaggttaagttactttaggtaggattgaacccagttgcccaatgccttagttgttattaaaagtttgttgcaggccaggcatgagccactgcgcccggctgtcttttcatctttttaacagggtctttcagagcataaattttacattttgataaatacaaagtcataaacatttcatttaatgaattatgcttttgatgtcagttttaagaatctttgcctagccctaggctctgatgcttctaagaggtctcaagttttaggtattattttagcccatgacccattttgagtttgttgttgttgttgtttggtttacgga

SEQ ID NO: 394158 - DNA, 522 bp, Homo sapiens
ggctggcaggaccaagggaaagcaaaaagagaaagcagataagctataagtctgcatttcttcatggtcccagacatgtagccctcctgtgcccaacttgtcaccagacacctgcaagttagctcactgcaaccttggtgttatcagtagtgcacaaagccctcttcagtacacagcacagtaccattctgtaaaatccccagcaagccttagtctctttgtagtcagctcctctcttgctgtcttcctgttgccaccttgcaacgtattttcctactttctttaacaaatctgcctttctttacgtacaactgtcttggtaaattcttcttaccccagcaccaccagctccaggtagttgctgctcacttgcaacagatacctcccctttttagaccatagagggtaattttgaatgttgccatggcatttgtaaactgtcatggtacccgtgggagtgtcttttagcatgctaacgtattactattggcatacaatgaacagtgaggatgactagaggtc

SEQ ID NO: 394159 - DNA, 428 bp, Homo sapiens
cctaaatgaatgaatgaaagaatgccacatattctgcggcagccctgcatttcacacccacatgaacacacacactctcattacactgcatgtgccaacattgaccatgctcctttccctatttcaaatgggcctgtaatggaaggtgtggaggtggctttcctcaccccggctgtcagagcatgctggggtcctgtgtggagggactgagtcctgtgtatcctccgcccacacatgacacctggccgcgacctccatgggtgctcaggaaggagctgttgaacaagattcaggggcacgtgggacatctgtgcttgtcagaggctgtgcaaggctccgcgagggaacagttccaaaggcaggtccagaaggatgttagaggctgggtttcttttgaacaaaagagcagcatgatgtgtttgaaaagg

SEQ ID NO: 394160 - DNA, 219 bp, Homo sapiens
gcaacagggaaaacctgtactccctccccagggccccgacctcaagctcccgagaggcctagatcattgacagagaggacgctggccaaggtaaagttctcagccctgtttgaccactccatgcatgtgaagtaggagactcttttagggaattagttgctgagtgaaactaagacttacttccaaaagggtcctaggtgccctgagaacagtggcccc

SEQ ID NO: 394161 - DNA, 176 bp, Homo sapiens
tgatataatactagtaaagcgcttagcatgcatcttgggcggatgttctcaatcattatcatattcagtattgtcatcgctcatactgctattcatacactcacctcacgaccccttaccctctactgtttatatctctttaactttcatatttcccctcttcttttgcctctgtc

SEQ ID NO: 394162 - DNA, 111 bp, Homo sapiens
gctgggagtacaggcgcagtgggtgtacttggagctgtgtgtgtgcacaggtgtagtgggtgcactcagggccatgtgtgtgtgcagccatgtgcacaggtctggcggggg

SEQ ID NO: 394163 - DNA, 378 bp, Homo sapiens
tgctggtattacaggcatgagccaccatgcctggcccagaattaactttttaaatgtaaagatatgacatcagtgcccataagaaccagagagaccaagagaaggccacaatcctaaagaactggagactttatcatatctttgaagtctgttaactaatgagctcatgcttataatttgaatgtacagagggctgttacttatctccattggtcatcctgtcagccgatgaatgtggtgaggctcagagattattaactagccttttcccaggtttggaagtcacgaagctgtaactcataccagctcttctgactctaggctcaggaatttgggcatggtaggagaagggagaaatactggacccaatttccaggg

SEQ ID NO: 394164 - DNA, 697 bp, Homo sapiens
  misc_feature (344)..(344): n is a, c, g, or t
  misc_feature (359)..(359): n is a, c, g, or t
agtggtcggttctggagctgcggtcttctgctagcctgatcgcagcttagcctccgcgcctctcagccctcggcgccgccgctggcgccgccgctgacccgcaggccgccgcgggccgcagagcccatgagggcgcgggcaccgtcgcgcctccgcggcgtcgccgtcgtcccggagcgccccgggctggcgcgggcatggccgcggcatgagcgtggagccgccgcggagctggaggagaaggcggcgtcggagcccgaggcgggagccatgccggagaagcgcgcgggcgcgcaggccgcggggagcacctggctacaaaggctttggcgaccaagtgtgtnaccagtgctgctatntgtcgatctttcgcttgagattcttttgccgttggggccctggttggaacaaacttccaattgtggatggttctactttgaacacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtggtattttgcgatgatttctgtgtctggagtcttctcggtcacgttttctgttatatttgcctatgtagctgat

SEQ ID NO: 394165 - DNA, 579 bp, Homo sapiens
atgctttctagggtggagaggatgggcagagccatccccagagaggaagctgtgtaaacgcaggcccagacccaggaaaactcccagcctgtgcagaggagaccaggagtcccctgagagggcgagggggcaagaaaggctgggactgaattgtgaaggctcccatgacagacactgtcaggcctctgagcccaagctaagccatcatatctcctgcgacctgcacatatacatccagttggcctgaagcaagtgaagaatcacaaaagaagtgaaaatgaccagttcctgtcttcactgatggcattccaccattgtgatttgttcctgccgcaccttaactgagcgattaaccttgtgaaatcccttctcctggctcagaagctcgcccactgagcaccttgtgatccctgccctgcccgcaagagaaaaatcccctttgactgtaattttcctctacccacccaaatcctataaaacggccccacccctgtctcccttcgctgactctcttttcagactcagcccacctgcacccaggtgattaaaaagctttattgctcacacaaagcctgtttg

SEQ ID NO: 394166 - DNA, 467 bp, Homo sapiens
cattaggagatacacctaatgttaaatgacgagttaatggatgcagcacaccaacatggcacatgtatacatatgtaacaaacctgcacgttgtgcacatgtaccctaaaacttaaagtataataataaaaaaaattagaatgctaaaatcccaaaaaaaaaaaagaaaattaaaattatcttaggcaatttagaaatagcaactgagatgagagctggagagaggcctttcatgggaaggtgagaaggggttacttagaattgctaaagggcgggggaaggggaggttcaacacaattttcttattttcttgattccctaatgctccagtcctttggacttcttggtcttaaggctatctgaaggacctaattagacaagtttcccatcttccactgattcttcaccgcctctccactatttctcaacctcagtttgtttcctacacactgccacctgtggccagc

SEQ ID NO: 394167 - DNA, 561 bp, Homo sapiens
gaggctggccaggccccacctgggggaggcttgagggcagggccccaaggctgagattcaggcttgggggaacagagcaggaaagagacccggtaccgaaagtgagcggggcaggcacctagtcacatgggtaatgggcaggggtcggtcactggctttggctccagggccagagcagtctgacttagtgttgagctccaagcatggaacactggagttggttcattttgaccagcaagcctctaaatgggtgccttgattacccaccgcaaggagagggcagttgcctttttatgacatgttaattccagccaggtgagtcaccaggtagctctcatcctcctgccaggctcccctgcctgtcggtttggcattgtcagataatgtgatcattcattgaagtgacatttgagttccaaaccagttttctcctttaaccatttcaccctcaggagtgattctcctttgtttggcattgtcagggaatgtgatgatccattcaaatgacttttgagttccaaatagtgtttctactttaacttcctaaatgaaaaaaaaaaa

SEQ ID NO: 394168 - DNA, 437 bp, Homo sapiens
tatggaaaaatcgcagtataagacatagcaacaatagaagtacgctctctgcacgattaaaaaaatgaaaataaaaacactgaaagagttatacgcaaatgtggagaagagcaaacaaccgtttgggaatccatatttcattaagaatttatcagtgcctagtgagcatccagccttagcacagtatccacctcgtaactggtagacataaatacttagtaaaagagtgagtgaatgaataaacacaggtgtttgtaaggcgacattcttggaatactgctgctgctatatttcaactcagtgaggttttgtaaattcaaaaacttggattttgaactcaagctgcttggatttgaaccctggctttactacctgctatgctgcaattgcttcatggggaaaagaagaaatggcaatcctaaaggatggatccctac

SEQ ID NO: 394169 - DNA, 481 bp, Homo sapiens
ttaattgtggtaaaacatacagaacataaaattcctctttctaaccatttttaagtgtataattcagtggcattaagtatattcacaatgttgtacaagcatactcagagttcttaactgttgtcaactaatcaaaaaatattttgaatactttaggaactgaagttatcaagtttataatacttgatataaatatcaagtttataatatgtgataaactacactctttatactgatagactacactggaggtggagggtaatacagacttcagctttagaaagcctcctgggtaattaccctatacaaccctgcctaagaattttgacctatgctgaatgttgactgctacatcccaaggttgtaaagcaacaagacctagctatgtagtgtctcaacaaatgcttggaagttttacagtaacactgaaggagtacagaaactaaaccattaaggtccccagttacacaatgtggataaa

SEQ ID NO: 394170 - DNA, 393 bp, Homo sapiens
aggccatcaagagaaacaggctttaatttgccgtggagcagcccagggtgtgggtgcaggtgatgtgcccaggcaaacagaagcagatttgccctcctcactgggtcccctccaccctacccaccaccaccatttaatcctcggcttcatgcaaagctgcctgctaggcaggttcccatatgggaaaatccaaggagtgcaaattctggaagcaccagataaatgcaccccttccttaaacagcaccagaattaagaaaggccaccctccctctcaagcgcctgctctctttaggataaggattgtgccagggacgggtgatggttagcgagcgctcactgccaaaggacacgtgggtaggagagggcagggagggacacacaggagcaatca

SEQ ID NO: 394171 - DNA, 323 bp, Homo sapiens
gtcttcacttccacccttgcccacacagattccatggaattttgcaaatattcttaactcccttttttcactctctctttccttccttttcttgtctggcaaaaccccaatttggctgacctcaaacatctaccttatccatgagagcctttgagcagctagataaactggactgaaggcatctacatctgggctaaccaatttcatgtaaaatgtgtgaccacaagtgctagatgggcactcaacactgcctggggacccagttacatttcctcagggggtgtgcctttcctctccttgagacaactattcaaacctcccct

SEQ ID NO: 394172 - DNA, 524 bp, Homo sapiens
agctgggattacaggcgcacaccaccacacccagctaatttttatatttttagtagagacggggtctctccgtgttggtcaggctggtctcgaactcccagcctcaggtgatctgcccacctctgcctcccagagtgctgggattacaggcgtgagccaccacacccagcctatgtgaccttgattttaaagacgcctcatttaatgttagtgttgattcatttaatagtgttaacattgaactcagggccagctgtagtaagtagtctgtggtgccatcatttcagcctgttagaaagctcatcccacaccggttttgtctgtaagacacctgacagccagcctgcacttaagaacagcagacagcacttcacactgcacctggggccacttcagacagcgatgtcaccagaaaaagcccaaagggcaaaacacccgacactcatcgtgaaaagacttgacagctaataactgaaacaggcagagcattatcgttttctgcctcagctgggatcgtcgcatct

SEQ ID NO: 394173 - DNA, 525 bp, Homo sapiens
gcgttctagagcatcacttaaaacgtatcagaacccagccactttcttcttgggtaaagggcacctcagtgtccttacctggggcctggaccaatgtaataggggcggagttccctctgctatgggatacctccaataggggagtggtttcccagaggagtttggggtttctcaataagaatgtgacattttggcttcccagaaatgtaaaaaataaagagtgtgacagggtggctgctctgtctcccccagacccctgtgagaggatagacattgttttcctagggtccagacgggagagggagcctcactcacttatttcacagatatttcctaagtgttatataccaggcactatcctcgggatgaataagagagacaaagtcctgggcctcatgaacctcacgatgagtgtgtgtataggggggaaaatacgctgaacaagtaattctcctgcctcagcctcctgagtagctgtgattacaggcgtgtgccaccacgcccggataatttttttttgcattt

SEQ ID NO: 394174 - DNA, 545 bp, Homo sapiens
agtaaggactttatctttaggtgccagcttttctcttgcaacctaatcctctctctactctcacaaagaacctgataatagtcaccagttacccttgttactgaccacacaatattttaaaatcgatgaattttagagaggcatacctcagcctagaactctgtttttcatctttctctcttttcaataaaaagattgtattgattgttaatgcaattttagaaagcaccaagttcatgtagaactaattgaggacccaaaagaacaccttgaaatcaaaataggctgtttgcaagtctagccttgagaataaaccatatcatttctttgaggttaggagtgtgaaagggtatgaagtgacagtctaggtatttttctcctttagagatggatctgtgatctctacaagtagacagagtaggggagagggttgacctatatgcaaatactaaagacctatttctaggagctatttggtttcagcagcttcttcaaggatgtaaaacccactttcatcctatcccctggcaggtccttctctctag

SEQ ID NO: 394175 - DNA, 512 bp, Homo sapiens
gagtccacagtacaatgaatggagggtgttatcataccctgtgatgggcaatccagaggaagacctagtttgggtaggatgtagaaggaaaatacaaatttggtgtgcaatagattgagtttgagacacctttaagacaggccagtgtagatgttgagttatacagggagcttgggaggagaggtctgtgctggagattttggggaataatcccagagtagagcatgagtgaagcccaggtcatgggcaaggtcaggagtgagaagagaagagccaacaactgcagactccaggagttccagtggtgaggctggtgcccaggaataagctggccaaggagactgggaagtgatggctcaagaagtaggaggaaaaccatgaggacatcatgctgctgcaaagagtgtgagccctactcccaccttagtccaacgctgaaggcacatgctaatttactttaaaatggtttagttttagtgtgatttgttacatattacgggggtagatttgga

SEQ ID NO: 394176 - DNA, 478 bp, Homo sapiens
cagtagccacaggatacgggcagaaaaccgagggccagagaggaaccgtgactcggccacatagctagtaaagtgagttgtgcccaagcaggcagacagactggtgaactttgatgctatcctgtttcaagaaagcgttcattgagcacctacttcatacacaacagtggcctggctgctgaaggctgagtgagaagaaagggtaacagaaataaatgggaaacggatcctcatccgtgaagcgttcacatgggaaatgagggtcctcctcaacttatgtgtcacacacatagtgacaacttgagaaggtttaggtccaaccaacatgtactgagctccaacagtaagtactcatggccagaggacagagctgaatcagaagcggccccagctgtcaagccatgtgtgaccatcaaagcccaaacctgagtatccaagggccacaggggtgagagggtgttggggaaatctaggaggg

SEQ ID NO: 394177 - DNA, 291 bp, Homo sapiens
aatgccatgagaatgtggaaagcaagcctccggagagcgaactcactctgagaaaggctttgaagattgttttctcatctgctttttattttcatatgcaagtacggtcctctgtagtacatcttatctctctctttagccagaaatactttggcccataaaaatagaagaaaatctccagctaagagtgacacaagtgcagaggttaaatattcagttctttgaagtgaaatcatttttttgttcttagtgtaatgataccccttttcctccctctcccttcctctccct

SEQ ID NO: 394178 - DNA, 402 bp, Homo sapiens
atgaaggcagcaacaactatctaagggttgaaaggttggagtactagcctggcttactttgcaggagtgacttctctagaactgctagcatgtcagatcagctcaaacatgaggtcatatgaagaggtgggcagattgaagtccgacaggcttccccactgcttttgccccagggtgcagatattagaacagaggctaccacttgtttctgtagaagaaaaactttgtccttcattttctgtgcctccaaatgtcacttaacctccagaagagttgtgttggtaaacataatgaagggattaaactagaaatgaattttgacagtttatagtgagagcttctgatttctgtcatgtggaacttcatgtctgtagcatttcagtatttgaagttcttaatatt

SEQ ID NO: 394179 - DNA, 221 bp, Homo sapiens
cccggttattttgtattttagtagagatggaattttccatatggccaggccggtctcgaactcttgacctcaagtgatctgcccgcctcggcctcccaaaatgttgagattacaggcgtgagccaccatgcccctcttacattatttccacacacctagtttttcagccctatacaggctgaccccatacctgccatctccttttcacttcctgttctttc

SEQ ID NO: 394180 - DNA, 385 bp, Homo sapiens
ctcctcacttccacccccattagataaggttcccttgaattacatcccattgttactctgcagtcctttgcagcacttacaacattactaactgtaatcactctttatgtttgctctgctagaatgtaaaccccatgaggactactttattattcctggagcccttaatgtctacaggcatgttacaagcacttagtttcttcttaaagagtaactgactaatctaactctccccactgatctgttcactatatacccaaatttcctatttagacaagtttattcctggactctccattctattccactaatttgtctgctcttgtagtcgataaattctcaatatttgacaaagatccctttatcattcttctcacagaatttt

SEQ ID NO: 394181 - DNA, 557 bp, Homo sapiens
ggtatgtctttatcagcagcatgagaatgagctaatacaatgagcactcatcaatctggattttcatgtgaaatctcaattttttaagtgttggtaactacatttaaaaataaatactgtgggtatctataggggccacctatttttgttatcttctgggtcagcagggaatgtccttatctttcttgtttctgatcaggctacaggaaaatggattgctagagaacagaggttttgtgacggagtggtataagaagaaatctgatggccaagggcttgttactgggtctgtttcaaatgccagcaccttctgtgtctgccttcagacaacaccaaacacctaaatcatcttggtaaacacagatagaaagagacagaaaggttaaaagtatactcataatcacttgctttttttcccctcctaaacgtgtttgagagcaatattgtttcgtaaaaacaaaatgaccccatttctaaagcaatattcatgctaagctactcagctgttaagtataaccagcagtttgcattatgatgaagctaagccagaatttcaa

SEQ ID NO: 394182 - DNA, 418 bp, Homo sapiens
agccaggatggtctctatctcctgacctcatgatccgcccaccttggcctcccaaagtgctgggattacaggagtgagccaccgcgcccggcctaaacttaattttatacaattatatttgattggcctgtaaaacctatttttcgaagcacctaaaataattttgcataagtttgacatggctgtgagttctctggtgtcagactttatactggattgtagcttcagaaacgccacgtttcagaggaactaagggtccctctggtggtaagtaaggagaactcttctagctcagtgggtggcatgggtttaatgcttgtaaaggttaaaaactctcattctggattattgccttaggttgttagccaaggacaagggtagttaattgttttttttgtttttttttgttttttggttt

SEQ ID NO: 394183 - DNA, 815 bp, Homo sapiens
cacagtgaggacaaccagaggtcactctcgtggccatcttggttttggtcagttttggccaccttctttacggcaacctgttttatcagcaaggtctttatgacctgtattttgtgctgacctcctatctcatcctgtgacttagaatggctgcgtctgagaatgcagcctagtaggtttcagcctcattttccccagctcctattcaagatggagttgctctggttcaaacatctctgacactaccacccaagcagccaccatgctgcgaccagtgcctggatgtgagtgaatttcatcataatttttgtactatctttgcaaattatggacactactgccactcctcacatcaagtccagctgtcttttaagcggagttgaaatatcacactacagatttaccagtgaaacagaaagttattttatctgcaaaaaggcctggaaacagaaaagcaaggtgcctatttgtggtggatgaatgacctccatttcatactttctgcaaagcaacgagcaagagctaagcgataagaaatcattgtgctctgctgtaatcggtggtgcctttgcttccacagtgacaggaaacaaggatgcattttacactcttggaatttagattctgtgaaacatggcaataaataatgtttggacagagtgaatagtctataattccagaaagttccatctcaatgttaaaatctaatgtttaattaacctttcagtttaaaccttgtcatgtggcagaccctcacacccagactccctgcccaattgtggcagataacaaaggcctgtgggtgaatacccatt

SEQ ID NO: 394184 - DNA, 325 bp, Homo sapiens
cgtagagtttgaggtgcctatggatgtcaacttggagagattatatagatagttggatttataagccttaagcctagagccatggatttaaagtctgaacatcacgaaaaggacacatggagattaatgaaaaaataatgagcacagggaaaggagttcattaaggaatgattggagagatacaacaagaacccaaagaatgtgttgtttcagaaaacagaaaggaataaagaactttaaaaagaaggaaatagtttacaatctcatgtatggtccagtgagataagggctgaaaagtgcccattagcttttgcaagcaggaggt

SEQ ID NO: 394185 - DNA, 575 bp, Homo sapiens
aggtgcctgccgccatgcctcgctaattttttgtattttcagtagagatggggtttcactatgtcggccaggctagtctcaaactcctaaccttgtgatccacccgccttggcctcccaaagtgctgggattacagacgtgagccactgtgcccggcctgctttttctttttttccccaaaaattcaggaaagaatgcaggaagagaaactcaaaacttaaaacactattagaagagtcctgcctctgcatccctctacccacagcagccactagttcaaccatgcattctgcacagcttttctggcttctccttctcactcttcccacttattggcttctgatttctaagattacctcctaaaactctatttgtaccctagtctttgtttcagagctctgatattgtaggaacccaaacaaagtcaagccctgatggttccctaagatccagagcctcacttctaacttccttctctcattctcattctctctctctcctccctctccttcttctctctccatattctacccagcatattcataattaaactcatcaccattgtttcaaacctg

SEQ ID NO: 394186 - DNA, 354 bp, Homo sapiens
agaaccaatacaggcaataaaacacaccaagaattagggaaaagctaaagcatagtccaattatctcaattattgtaaatgagaagtacccttcacctaaatgaggctgagtagaaacttccttacctctgcaacaatttataactgtggaattagaatttagattcaagctagcaaaactagagctacattttatactcaaaactatgtctgccacttaaaagaggaaaaaaaagaatgaatataagctggttatattgaagtatattttacacagattttttttagtagttaatttcttatttagataactaggaagggtaagtggaaagatacatatgtttttaaagaggg

SEQ ID NO: 394187 - DNA, 424 bp, Homo sapiens
cagcagaggtgggtacagggctttgtaagtggcaaaggactgataagatttgagaaatgcaacagggagcaggagaagcacagggcagctagggggtcttgattctagggtccccatcggcatctgggctcaaaaaagagttccatgtctagtggacaaaggcaccacttcaaaatacaaagaccacccagcagggaaaaccaatgaggacctgatctgggaaggggggtcaggctcagaagggagaattgggcatgagcaaagccacaggggaggaaaaaagcaagacaggcccttgagggtggtcaagggacaccagtaaggtcactctggaggtcagatgcgacccagagtatcagcagctgcacatcgtggatcagtcaagaagcaggcccagtcattctagcctgaaatagtgggagat

SEQ ID NO: 394188 - DNA, 241 bp, Homo sapiens
tactttcaaagggtcattcttatgctgggttctggaggctcttcaatgcttaactgtcaaaaaatcataacttcctggaaacttttttttcgcatcctgggtcagccactatagggctgaaaaggaatgtgacacatgaggacttcagattctaaataactaataacctgactagggagaccagactattacccctaaggttatcatccgataacttggaatcacacatacgtgagtctca

SEQ ID NO: 394189 - DNA, 372 bp, Homo sapiens
gtagctaattgttacatcagctataaagttgttggttttttagattatgcctaataatcttgagggctaagctaccccaacctataatagaatttatctcttcataagtatatactatgatggtcctcgtagaggtatgatactgtaataaccatgtacctgtctctcagctttagaatttgcagttacacttggtttccaaaaatcagagattctggattttaagagcttagactagccactaaaaacctgtagaatgtctaataatcaccccaaatttttactagtcaaccaagtgttattttttatccatgtggcaactgggtcatttctttgcttctcaagcctataaagattagtaattccttggtt

SEQ ID NO: 394190 - DNA, 509 bp, Homo sapiens
cagccaacatttttactgatagatgataagggcttaaataaaggcagcactcgtatgaatgaaagggagagaaggagtcaaaagaagattctaaagtagacttggtgtggggaaatgaaaaagaagtcaaggatgacttcaaagtttttagcttgatgaatagaaatgacattaattgatgtgagaggccaagatgatgagactgactattgaagttggggtgcctgttaaataattcagatagtgataatgcaaacatagattctatgtagtgtataaatcctgatatttgcaagggtttggtcctcatttctattttgtttgctgtctctctcaaaccagcaagtagagaagagaggaagatggaatcctaataaacaccaagatttaatgagggtgaaggatgaggcaacagtagaacttgaatagaagtgctccaggtgggagagagatacaggatatggaatcatgagaggtgtcttttttcccctttctaagatgagtttttt

SEQ ID NO: 394191 - DNA, 805 bp, Homo sapiens
tagcacgtgtcatctgtccaggaggctggatttccgtgctcccgtgctgatgggacaatggtgagcaagagctccgctcaggcagtaggtcacttcccactgagcactgggtcgctcccgggcaaagctgttgaaccctgggaatgctggcccatcttggggcgggatatagggaggaaggaggctggaggagaactggccaaatgagtccctccctccttcccgtgcagagacactgttggttttgttcatgcagtatctccggtgcttaatgagtagctgctaaagtgaataattgaattcctggggccctcatcttccttggcaagctgggcttctgttgatctaaaagggactgaggatgaagaagagacttctccggttcctgctctttagggacaggctagatgacatcagcttctagaagcttcctggaactctgggtccagagctgagggaggggtcaccagggtgatatttgacaccatgattgtcctgagaaatctaggatgcaaaatcgccatcaccatgcaggatatacagacagacaagccaagcgtctcagtgcagaccgctcatagtcttaagatcaagcaagtttttcccaatagcaaagtcgtgcactttgaagatttctcttttgatgacctgatcacaaacttctctgaactgtctttcctcaaaatgcaatgaatttaagaaatttgcagtgaataaataagaaccaaagtttttttgttgatcttatgaatgttttccaaaatgtgttaccactggtggcacacaagataattctcaaaggccc

SEQ ID NO: 394192 - DNA, 383 bp, Homo sapiens
aaagagaaataagttctatgtattaggctgacttgtctgagaggcagcaatgggcacagcccagacccaggaaaagtcttgataatactatctaaagtgctcttggagactctcccagcactccctcaacatagagagaagaaaaaacaaattttcctttgttttatggaatgagtttatagattcctgttctctgtaactcatgacttcaagtattctgttttatctaagaagtacagcgaaggtcatgagaagcctgagctgcctgggcaccacagtgaaggttatgggataagcccgtgcctaggctaacctagataagggacatctgggttgcatagcaacggttatgtgcaatcctgagttataaacctgttacaaca

SEQ ID NO: 394193 - DNA, 344 bp, Homo sapiens
cactgatgtgggcacactcagctggctgggtaaggaagccacagtctcctagagtgtctctggacaccataagcccacagttcaatgaccagagcttcgtctgcatgagggccaactcctcaatgccgccgcccctctagtctctactcctgggtaggcctcacaggcagaccaatccctgggcagcacagagtctggagcaagacagaggtgggttcaaacactagctcctctcctttttttttttttgagactgagtctcgatctattgcccaggtcggagtgcagtgacgtgatcttggcttactgcaatctccgcctgccaggttcaagcaattctcctg

SEQ ID NO: 394194 - DNA, 591 bp, Homo sapiens
cctcgcgggcacagttctcagtagggttggcactctggcaagaatgctaacggcgctgctgtcctatcaggaggcagagctcagtcagtaatgctcactcgaccgatgttcacctcctgatgcacggccctgttcccaacagttggggacccctgctgcagggcatctatgctctgtagcccccaaggcatagctgggacccatgggggcatcatgagatgcagattctcagcagaacctgagcaaggaccttttccagacagaagtatccccctaggaacagggcagccccaagggcggagggatgagctctctctcctaggagtgtgcagagtggaaatagccagccaggaagcctcagagagactgctaccccaggtgggggtatcccacaagcctctctcgtcccaccccggcatgttaggatcagggcagtagcaagaacattctgacagtcctggaacactgtccagggttggaaataaggtggctccagggatgacaggagatgaagatcagggctctaattcaaacctaggtgccatcattactggctctttaacttctacactaagtcctttggaaaattct

SEQ ID NO: 394195 - DNA, 125 bp, Homo sapiens
gagctaaggtctcactgtattctttgccatgctgctcttgaattcttaggctcaagcgatcttcccaccttggcctctgaaagtactaggattagaggtatatgccaccatgcctggccataaat

SEQ ID NO: 394196 - DNA, 440 bp, Homo sapiens
tataaactgtctctgagtgaaacatagtaagaagtagacaagaaaacaacatacaatagataaacacatttacccagaatttatagctttcaggtatcattaatttatttataattaaaatgtttttgaatttttggggaaatattctgtatgtagtcgtgatgacataaaacttgtttttgtattcctctagtttcttaatcatacagaagtcataagtgtacaagagtttggtgtcattttatacaggaagagctaattatttagtggctcagctaacaatgggggatttcgtctgtatagctcgtactttggaaattccattttctatctgattatacagttataaaatgtcaaccagtgtacctatcatttgaattgaatttcccaaagatgtgataggcacatctaactgaatcaccatgatttttgatactctt

SEQ ID NO: 394197 - DNA, 429 bp, Homo sapiens
tctcattttagagagacccacagcagaggtcctgattcatgaaccaggaggcctgggaacctgcttgcttttgtaaaatatggtgcttaacatgtccttgctgcagatacattgctgggtccagggagtttcttgtttatctcaactgttttacattttacatttttctcatttttaaataataaacaaaataaaatacattccttttcttttgtcctcatcctggaagaattaaagacgagatgagaatagataaccaagtcaggagagggttgaggctggtggaagaatcagtagacattgccagcatttttttctaggtctttaataaaatatctaccagaactttttggagaacataatgttaaatcataaagggaagctcaggatgccacatatatttatgctgggcttaagcccaggatgctg

SEQ ID NO: 394198 - DNA, 310 bp, Homo sapiens
gacgagggaaacctaggtccgctcaaaacctaagcatggttgctcacagcagctattgtatttgtagtaggccgaaaaatggaaaaactaatgtacttcagtagacagggggtcaaacaaacaggggaacctccacccagtggcatctcagcaataaaaaggaatccactcctgaggcccacaactcagaaagacggccctgagctgcggacgagcccgcttctgaaaccttctcataacgacaggcctgcagccatggagacgcatttactggtttccagggttacaatggctgcgtggccgccacggt

SEQ ID NO: 394199 - DNA, 394 bp, Homo sapiens
tatcccgacttcagagggcgttctcgatggttatcgagatgttgctggcccttgtacttccccagagaggagaatccagccaagctggtcagcaagagcctggggtgggtctggaaggagagcttcctgcagtgaagaactccgatgcttccagggccacctgccagatatggggcacagtccccgcctcttccaggtggagatgaggtgttgaactgggcccttctaagaggagggcagggggcagtgccttagcagagcttctaacccacgtaagtgccttcaatgccttcctttcctgccacattaccaaaaaatatactgttattgttgatgagctagcctgtctccccaccgtaagggcaaccgcaaaatggtcgttttctctctcctg

SEQ ID NO: 394200 - DNA, 767 bp, Homo sapiens
caccccctctcatatttctctttgtgtcagtatccttctcatggtgattcaggtttgaaacttcaaaaccgtttttgaatttattttctcctttccctccagtgtatataatctgctgccaaaacacattttctgcttcaggtggtactagaagacaatcagatgctaagcatttgttagccccctccatatgctcattaccatgctagctaccggtggggacacagaagaaactttacatttgatgcaagaaaagcacagaagatcatgcctaggtggtctctccaatttccttgtctgtcaaaataaaaagtaccaacactagcttgttcagcaagtagttaacgtatacatacatatgatgttatttctattcagtagggcctatgaagtagatgcctaatttgtagaagaaaactagtgccagaatctcagcagtttgaaatgggcataaaggataataacaagacatcacagatccaggtaactcatacaggatgatccattactacttgaaatatgtactaattttatggtaaagtctaaatcttagatcaggtcttctttgctctcctgaaaagataatcatagatatgggtatgagtactatctctctccttccctgcctgaaagagcttggattgggtagatggaacagcttaatttttacacctcgtaccaattacaggccatgatttcaaaatgatcactcaccaaatctcctttctaaaatttttttagaaacagggtctcactctgttactcag

SEQ ID NO: 394201 - DNA, 342 bp, Homo sapiens
tttgtgtttagatgagagcagtgttgattgcagtttgacatctgattttttttttaattgagttggtacaagcaggatgtcattggctaggtgacaaagtcactgggggaccaaataccaagatgcccgttggtgagagagaccctccccaggaccctccccaggcgcctccttctccgtgacgttcaggaccctccccaggcgcctccttccccgtgacgttcaggacccctccccagggccctccccaggcgcctccttccccgtgacgttcaggaccctccccaggcgcctccttccctgtcatgttcaggaccctccccaggcgcctccttccctgtg

SEQ ID NO: 394202 - DNA, 267 bp, Homo sapiens
agttccagaggccccctatagcagcagtcttcatagcatcacctgtagctttttttcttttttaaatatacagatgatcaagccttagcccacatttattgactcagaataaccaatgaggaattttttttttttttttttttttttttgggtttttgatggtttcccgcttttttatatggtgggggggcctttggtccttctcctttgaaaaattgttttagccccattttttggtgggtatattatttgtttttttttctttaa

SEQ ID NO: 394203 - DNA, 218 bp, Homo sapiens
ttaaagacaagagtttcactctgtagtgaaggctagggtgtagtattacagccatagctcactgcagcctccacttccctgggtcaagtgatcctcccacttcagcctcccaagtagctggaactacagatgtgcactgccacactcaactaatttatttatttatttttatagagttgggtatggctatgttgcccaagctggtctcgaactcctgt

SEQ ID NO: 394204 - DNA, 214 bp, Homo sapiens
gatctcttgaagtttattctttttgtctaactgtaattatgtatcctttgaccaacatttacccagtagtgggattgctggatcatatggtggttatttctgttttaaatttttttttagaaaccttcatattattttcagtaatggccaccaacagtgtgttaaggattctcttttctccatattctcagcagcacttgttgtcttttgtctt

SEQ ID NO: 394205 - DNA, 379 bp, Homo sapiens
aaaggtactcattctctgccttccacattgcagtgttctttatcaaagtcagttgactgtgtccatatttgtgttgatcatgtttttgttctccctgtttttgtccatagtttatgcaagtatcatatatcagctgtataactacaacttggcagtgtaatttgatattgaggattgtgggtcttcactttgtatttctgaggattcctttagatattcattgcttttgtggttccctgtgatttttagcaatacctatttatttctattaactttttttcacaacataaaggtccataattaggggtacattttcatacatataggttgggtaatgatcaaatcagggtacttaggatctctatttgctcgtccaggc

SEQ ID NO: 394206 - DNA, 289 bp, Homo sapiens
gagtttcacaggcaaacaacttttaaaggtgccacccactgtctgccacttgccagggccacagggagatggctgaggagtcaaaagtaagatctgaatctactctatgggtttttacatagaaacaccttttctgtatcagaaaagagaagtcaaagtcaaaatcctacctcagagcttgggtgctatctagacaatcagtttttccccataaactcttatttctttatttctttctttttccttttttttttgagatggagtctcactcactcaccaggctggagtg

SEQ ID NO: 394207 - DNA, 132 bp, Homo sapiens
aggaaggcgaagggactaccagcccacaggggcaaatcacacacaccggagaggctggaacagaggaggtttcctgggctggaggtgaatgttgatggatgaggaggagtgggtgccacggagtcttccccg

SEQ ID NO: 394208 - DNA, 548 bp, Homo sapiens
acttaaaataaaagaaaaagccaaataaataaaatcaaattgaaaaaggagacattataagggatactacagaaataaaaagaatcactagagactgttatgaactatatgccaacaaactggaaaaccaaaataatggacaaattcctggacaaatttaccaagacggaatcagaaagaacactaaaatctgaacagaccaataatgtgaaatgtgattcattcaccaataaaacatctcaaaacaacaaaatgcccaggagtggatggctttatggctgaattctgccaaacttttaaagaagaactaataacaattcctctcaaactactctaaaaaactgaaaacaaagaaatgcttcctaattcattctacaaggcccgcattaacctgataccaaagccagagaagaatacaagagaaaaactacaggctaatatacgtcatgaacataaatgcaaaagtcctcaacaaaatactagcaaaatgaatatctagtaacacattaaaaagataaataccatgatcaagtgggatttatcccagg

SEQ ID NO: 394209 - DNA, 526 bp, Homo sapiens
agtgtctgcatgtgggagaaatatgaattgcagtggctagagggtagaccatgatagattatttacatagattatcataactgctccttcacaatgtgactttccccttctttccatcaaaaaaaaagagtacaggatctgactggacttggacccgcttttataaacagaatgtgacaaaaatgaggttatatgacttttgactataaatcttgagcctctgctagcttctgcttttcactttcttggagagctacacagagatcaccatgtaaagaaaatgatctagtttattggaaactgccttggttctctgatttaataccagatctccatcatcagggagtatgaaggcactccaagcaacagttagacatgtagttaaggccattttgcaccttctagcctagccacacctctgcctaaatgcagctcctgaggaagcacagacaaaatcaacagaataacaacccaaccaaacttcaaaatcataagaaatagtaaattcttgttgttttaagtcatg

SEQ ID NO: 394210 - DNA, 527 bp, Homo sapiens
tgggatctagttcaggatacagtagacataacttgctgacggcctgcatatgggaggggcactggtaagggagaggtaatcaagactggtccttggtttctgcttgaatgaatgatgagtggtagaaccatttactgacctgggaggaaggattcttggggtggggcaggaggacagtcacgagttacgtttttgtctgtggacactggtgagtctggggcctcagaaggagatataaacgtgggcaccctcagcatatagccctcttattcttcccctagtagctttcaatcctagagcagcagtccctaaccttctgggtaccggggaccagttttgtggaagacaatttttccatgggccagtggggagggggtatggtttcgggatgaaactgttccacctcagaccatcagacactagttagatggttctcataaggagcgtgcaacgtagatcctcgcatgcgcagttcacaatagggttcgtgctcctatgagaagctaatgccgctgctgatctgacag

SEQ ID NO: 394211 - DNA, 250 bp, Homo sapiens
ggactttcaacactagactagccatgagactgacctcagaggtgaggcataaaggaattttgtctttgcaggcagcttgtgcgatggttacacactagaattctgagtttgaacccaagtaaacttttcaggagaggaaacaggagtttcccaggtagaaagtgggagagccagagtttgaaacaaaagcccctggccaggtgcagtggctcacgcctgtaatcccagcactctgggaggccaagacagg

SEQ ID NO: 394212 - DNA, 689 bp, Homo sapiens
tgtcctgcaactccctagccctactgagtctgaatctgcaactaataagttctttcagtgactcatgggcacattaaaatttgagaagcactgtcattgaggttagaaatgtgggccttaaagcacatagatcttggttcaaatccccattccaccttgagcaagctaattttctaatcttgtttcctcacctgtgtgatataatcataggtacctcataaatactactatgagagataaataagatagttacatataaagtgtttatgtagtgcctacctgttagtaactgttcaataattttacctgttttttactatttttttctctgctgagcaagagcagaagaaagtagtgaggaagaagcgttgttggtgtgatcttcctttttttctctattttctcaaccatatgctcactatgacaggaaaaaaaaaaagatttaactgcaggcacggacttgcaaataggtgtaataatctttctgagtttcctccactgctaaatgttacttctacttatattactatggataagtcccttaacctctttgagccttattttcttccttcatagtgtggggttgcaacatcagcctatctcataaagtcgtgaaaaccaaacaaagtggtccataagacagtattatgttcattgttaagaactattttgtagaagttaagatggca

SEQ ID NO: 394213 - DNA, 435 bp, Homo sapiens
cttaaaaaaacttactatgttttggatatctttgaatatcagtctatagagacttattatttttaacagttgaataatattacattatgtggttgtaacataatttatttacaaaatcctctattgatggatatttaagctgtttccattttaaaaaatcattgtaaacaatgctgtaatgaacattcttaggcatatatctttgtgaatctgtgaatatttttttattttcttttttttttttgagacttgagttttgcccttgttgcccaggctggagtgcaatggtgccatcttggttcactgtaacctccacctcccgggttcaagcgcttctcctgtttcagcctcccaagtagctgggattacaggcatgtacaaccacccccagctaattttttgtatttttagtagagacggggttttaccatgttg

SEQ ID NO: 394214 - DNA, 253 bp, Homo sapiens
ttcaccaaggcccacagagcccagcgtggtctggccctgactctgctttctcccctcgccccagctgcacattaacaagactggccccttctctgttccttgaatatgtcaacctcagtcttgccttaggtcttctgcccttttcccatcctgctcttgatcattttgaatggctggtttcttccagaactcaggccttgcctgactatttaatccaacctgacttcccagctactctacatcacatcactct

SEQ ID NO: 394215 - DNA, 447 bp, Homo sapiens
cttcccctccccacatcacggcgggctgatggccctttccaaattgcctacaatgctcagccacgaagctgccaaggactcagaagcttggcttctcaggtagacgatgtgaaggtgaaggcggttgtcttgctgtcgtgacttgcatttaaagcccagtacctcagctccacactcacccagtcccgtcctggtcttcatcccagcttctctctgacctacgcttagcctctcctgcctggctcagcgcacccactctcaactctcaggggaaagaaagcccagtcccaggtctcagcccacccttcctttgtgctgtcccttcccccacaaacctgccctaagaaggatgacgactgatgacaacagtcaacatttactgagtttgttaggcaccagccactgtcattatagtatttataatactattatacaattatataatca

SEQ ID NO: 394216 - DNA, 487 bp, Homo sapiens
tacaccacctgagtctcaaaggacctgcctgataattctcaaaaggaaaaaaaacagctattaaatgtagaaaaaaggttcaactatctagcatctcaaaaaatgcaaattaaaacaaggtacctttttttgcctatcaaattaataaagattaaaaaacaaactgatagtaatactggcaaagctgcagtgaaacgaataacaaactctcacacactcacagctagtggaactgttcactggctctttccggaaagttattcagatgtacatataccttgattctgactctttgactcagtaattccactttcagacatctactgtgaggattagaaggccttagacacaaagctgtccattgcagcaccatttatacaaagtttgaaaatctacataaccaacaggtaggaattttttaaaaattaattttagcacatctatgcaaatttatatgaaaaagagttcttaatgacatgaatagctg

SEQ ID NO: 394217 - DNA, 423 bp, Homo sapiens
cctcctcctgggcgaattcctcctcctcctgggcgaattcctcctcctcctgggcgaattcctcctcctcctccctatgtatccaaaactgggcttggcatcgctgttcctgagggagcgctctgtccttattagggatccgcctggtgacctcagatttacacttaagcttcaactttgttgagggaaaacattttttctctgtcaccaagagaatggagaacactgtgatcgcttttcaagtctcacctgccaggaaatctttattttgcggggggcatcacaacttcctctttttccatgtaccttagtttactattactttaagtgttttggttggattaacttcctgtatttgttcttattttaaatacattctttagttaaagtgttactcagtgaatggaaagagaaaaacaaggc

SEQ ID NO: 394218 - DNA, 583 bp, Homo sapiens
gcgcactcagaaagctcaccttttccagtctctgtccaggaacgtggcctgatacaactgcactgattgactcgtggaagtaacgagagcattgccctgctggagacttggcctgcgtaggcgtgttctcccgtccgcatctgccaagtggaacagctttgccctttagggacataggcaaacgtctgaagactttaaatttttaattgatagactttgtttcatagaacagttttaggttttcagaaaaactgagcagaaagtacagagttcacaggtacccctcccttgccctccaggtattcctgctgtcattaccatcttgcattggtgcgctacatttgttacaactgaggggctggtatgggtacattgttactatctgaagttcacagcttaccttagggtttattgtttgtgttggacactgttggttctgacgaatgcataatgaatgacatgcatccaccaggttgggatcatacagaattgtttcactggtctcaaagtctcctgggcttctggaaccattttcgattgtcactaagcgggcattactggcatttcctgggacagcgatgaa

SEQ ID NO: 394219 - DNA, 339 bp, Homo sapiens
gagactgagtctcgctctgttaccaggctggagtgcagtggcgtgatctcagctccctgcaatctccgcctcctaggttcaaacaattctcctgcctccgcctcccaagtagctgggattacagacatgcaccaccacgcccagttaatttttgtatttttaggagaaacggagtttcactatgttggccaggctggtctcaaactcctgacctcgtgatccgcctatcgcggcctcccaaagtgctaggattacaggtgtgagccaccgtgccaggcccacctgcacacttcttaattcctccatttaaatcattaaaaggcatggttttcgtctcaa

SEQ ID NO: 394220 - DNA, 707 bp, Homo sapiens
atataatttgtgaattacctgatgaaattttcctaattttgaatcatccttgcattcctataataaacactgttagaatggctatggtaatattttatttttgcatttttacttctttataaaataagattatagttttgtttgtttcttttaaggctcttatttcagtatcaagggtatgcagggctaactcgggaagctttacatcttttttctaagacctaggatgtagatctagtttacacagtaattttcaactgcaggaatattttgcctcccatgggacatttggaaatatctggagacatttttgtggtcacaactggtcacggtcgggaggtcttattggcattccgtgggtagaggggatgttactaaatgtcccacaacacaccaggagaaccctcacaaagaattgtctggcccaagatatcaatattgctgaggctgacaaaccctggtttaaataaatgtccaatttggaggatgagtctgtctttttccttcttctgcgtattggtctccagattttccatttcttcagttagttttcgtaactgtagattcttaaaagaaatgaacacttctcccatacttctaaggtgttgtaaagatgtgtaaagttttcactttttgcatcatattcacatgtggctatatgcccttttgtcttcaaagttttctttatcttgatcacttatcagagg

SEQ ID NO: 394221 - DNA, 624 bp, Homo sapiens
agttgatgaggttattttaagacatattaatataaagtaatttggaaatattcagaagaagatgacaaggacaaccccaggttgtagaggagaggactgggttggacattcagattgcattattacatgagctttaaatgtcttgttagtactgttaaaattttttatgcatttgggtagatttgcctacagtatactatcactataactagtatatttattcaattaatttccaagtgcaaatagtgataacacagccattttatcagggataaacatattatttaaagaacacacaccttaacctaatcatttgagttaatcattactcctgaattcctattacttgttatgctgaatataaattttcatagatgaaaactcttacatagtgtaagttcctaaaagtacaagtgcataattctccaccagagaatgaaaacattgctatacaaaatccatctgacctttagttttagataaacagaagctactacctgtgtgcagaatagacaaggagattcaatgggaacctcctcctgtacagcccaactgaacaactgccaacacaagcagaaaagcagatctcttttctatcctctgtactcctaggacttgaatttg

SEQ ID NO: 394222 - DNA, 250 bp, Homo sapiens
atggaggcccagcaatgggaatcatagtccagccatgatggcatagtcatgggagaagagagagggtggggatggcttccaggagggtgtgaagagggggtccagtactgaagggggaaaagatgcatcagaattaattaatgtattttgatgatggcaatagtgttggttgagattggtgaaggtagtaatatttgtgatatttttgttgcttttctccctagacattaactatgtgcttattttcccc

SEQ ID NO: 394223 - DNA, 356 bp, Homo sapiens
ccctgcccccaccccccaaaaaatgagaacactaacaactttgatgcttggcaaaaaaaagaaaaaaaaatacatcaataaaacaatttgtggccaggcgcggtgtctcacgcctgtaatcccaacactttgggaggccaaggtgggcagatcatgaggtcaggagtttgagaccagcctggccaatgtggcgaaaccacatctctactaaaaatacaaaaattaactgggcgtggtggcacgcacctgtagtcccagctactcaggaggctgaggcaggagaattgcttgaacccaagaggtggaggttgcagtgagccaagatggtgccactgccctccagcctgggcgacaga

SEQ ID NO: 394224 - DNA, 976 bp, Homo sapiens
aaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggattgcaccattgtactccagcctaggcaacaagagcgaaactagggaggcagagggggtggcgagccaagatagcaccatagtactccagcctaggcaacaagagcgaaactgtactcaaaaaaacaacaaacaccaaaaggggacagtggctaacccaaagtatacagagaacttagatacaaatgccgggaggaattcgcagtggcactcctggggcgggaggacaaagcggagcaacccacgaggaaatggcccccaatgcggggaacaatgtcgacggcccaacaggcgaggtccgaggacgaaataactcactcagaacaagaagcgccacaaaaagagtgacggaatgaggcaacaaagagacgagggacaggggaagcagcagacgtaggaagggacgcacaaagacacaggggaggccaaaagggcaccggagggcgacaggggcatacccaccgaaagggctagtgatgaaccaaagattgcacggggacactgaaagcgaacccgagagaaaatggacgcgaagaaagggccgaggcaagggcaggcacacgggagcaatacacggctcagagccaagtcaaagacgacaatgaggagaggcactagaaacaaaaggaagtaggggcactgagaactcgcagcagcagacaccaaaaataaggagcaccgagcaaccagtagtgccccatccaaaaatcactaagcagagagaaagcaaggacag

SEQ ID NO: 394225 - DNA, 196 bp, Homo sapiens
aaagtatagcctagagaaccctgacattctgcaaaatcaaaacgatttttggactttttgcccattttcactcgcattccccaaaaacatttgggggagaggggcgcggttctaaaagtttcatgacctatagtgacataattgctctgatggctgatgaaatttgtgcttgtttttttttttttttttttttttt

SEQ ID NO: 394226 - DNA, 314 bp, Homo sapiens
gttgagagctgatattcggctctggcataatttctctgccagcagtggggactgagtgggatgtgggagcagaaaggcaggaggaggtgaggcctaaatgcagaaacctggcaaagagcatttgctggcagttcaggcagaaaatgaaggatgtctaaatgagggaggtggcagtagggacgaagagacatggagcaggtgtgaatggtgaccaagacagaggagatgaaccctgcaggaaggccaccaggtggctggcttgggatggctgggtggctggtggtactgatccttgtgcctgggggactgaggca

SEQ ID NO: 394227 - DNA, 275 bp, Homo sapiens
ctgggggctgctatgtgccggatgatggagtcctctgggcctgtacaaggggcaggacctgggccctgggatcaggccaacctgagtcacactcagctgtgtcctgaaggcccccttgagctacagcaaaatctctcaaacacaccagccctgggtcctcacctgtccgtcaggaccacggcaagggacgagaacgccaaggacactccaggtatgcgcacaggcctcagccggtggagaggaaccactgcctcaggcagccacgctctgccttt

SEQ ID NO: 394228 - DNA, 373 bp, Homo sapiens
acggattacctcaacttattttccatcttattttctattgccctataatatgagtgcattaatttttgctaagctggtctaatgattcaaaaacaaaaaaaaagtgcttctcacttgcaaaacaagcactcaatgcctcatgcaagcatatttaaggctttatatcacatcactaacattcattccactgaccaaagcaaatcctatggccaaacccaacatcagtgggatagggctgaacagtaatcaaaaagtacccaacaatgaatgctaaaattttaactgattaggagaaactgcaataaattatttctacatctacatttttacatagagtcaaattcatattaataagaccctgaaagaaaagatc

SEQ ID NO: 394229 - DNA, 480 bp, Homo sapiens
acccagcatgattcatttgtaggcttagtacaaggaccaggaatagctgagatctagctgtgagcagccacaatccaacccagcacatagggatttgtgcagttttaagctccagagagctgtttcgtggtatctatgccaacacgtactgcagataaagcacaaacccaaattgccccactaggtcaggaagcagagttggtgatataagcacctaggaggtggggcagcaagacagacagaaaaggtcaagaaacccattagctagaactccttccttagcccttcatccttccctgctcagcaggggaaggtcttgcctgtctttttggtgatgatgaaaagggacacgcttcagaaatcccaaatgttacctttgaatgtaggcgccccggtgatgcctatctttcctccttacctttgatatcttttttcataatactttatttaatgctgaacgtgttacacaacgtatcagcc

SEQ ID NO: 394230 - DNA, 158 bp, Homo sapiens
ggaccatacctaccttgggagccacagtgagtcggtggcacggtgaaagtgccagcgacttccctggacaggtgtttgtcaccaaacctgggtgtcagggtttagtccacataagcctgagcctcctggggtgggcgggggcagttcctctggacatc

SEQ ID NO: 394231 - DNA, 456 bp, Homo sapiens
gagtccatggtatagaaatgtccccacagataaatacatgtcgccacttttaaaaggtgtcttatctctattatcattttcctagactgtccaagggattgcatttctgcacttccatttgaattacaatgtgcttttgaatgtcagctgaaacattcccagactactttttaaaggagtttttggctgtttaaaaggcatctcaggggttgtgggtggaggaggagaagggaatgattattcaactgtcgccttttctttgaggacagatgtggccaaggggctgatgagagctggataattctccagagccttcagtttcccgagggaacttgcttttaagatggcaacaagatatgaacggagttgttcttagggtctgagacctgcaaggtcttggtttacttcctcagtgattcaatatcctgcggacagttttcgggttccatcttgctt

SEQ ID NO: 394232 - DNA, 376 bp, Homo sapiens
gctgtggaagactctccatcccccttcttggagcaggaccttcagtgatatggacagtgggtgtcaggccagctgacctggttttacttcacaccggcagatccagggatgcagccaccatccactctgctttatttagtgagacagcacttcataccaacagcaggcttaatcacagtctataccaacatttcacttcccatttctatgtctgtactccttgccttttggttatttggggtggggggtggcaatagcatgctgattctatcttccaagcaccctccccaaatctcctacttccctgctgaaaacgattcccttctcatgttaatttgatgacccagccagctgcacccctccgcccccgcacccc

SEQ ID NO: 394233 - DNA, 368 bp, Homo sapiens
acagtggaagagggaggcagtggtgacagtggagagggaagacagtggggaggtagaagggaggagggtaggacagtccagcccccattggcaggggcagctggggagagcaggccccgcctttgtgtgccccagggcctgggcctgcctggttaagagtctgcacactcctagagctggagcttctcaatgtcgctcttggaaggtgaccccacactccgctggggataatgcagggggcccaggggtcctccctgggaaaagtgtgctgtgccccgccatagggttcgtggcagaagcccctcccctgagctcaggcctcacctccggccactgaagacaaggagatgcagagaggaggcctctgg

SEQ ID NO: 394234 - DNA, 847 bp, Homo sapiens
tacccctcctccccaggactggtgctgtggtgggtgcttatggagtgtgggggctggtctcccctttcctgagttaccgtggatccctaatgaattcaacaatcctgtgcttggcttattggggacatagacctctaaccaagtcctgtccacccacccggcactcttcagccctgccctgtgcccttggctcatcttttccatagggcccagcggataactgcacctgctctttctgccaggccaggccaggcctgggctggacccaggaagagctcagtacttctgtgagctccctgaggatgaacttcctcctgctgctgccctcaggagccagcacagggccaggcctgggaagcgcttagagctgccatgggaaaggggcctctgccacctcctgcccagacagcagggctggcctgtgggaaagctgagtgtaggtctggtggtggaaggtcaaacaggttgtgtgggcttagaggagggagggagcggtttgatggacttcctggaggaggaggcatgccctgagcacaatggagttaataatcccaggtcattatatgaaaaaaagcccctagcagaatgtttggcacatagtgagcgcttagcaagtggtagctgttgtcccagggagaagtgctgagagctgggtgaaggcgcggttgtgaggatgggctccaggttaactgggcactgctgtatggagagtttggggagctgcagaccttctccagtgatgaggatgcgagtagggtggtggtcattcagtacccacttactaaagccccttctgtgctgggaactgctggcggcatggagaggactggccctaggggctcccggc

SEQ ID NO: 394235 - DNA, 320 bp, Homo sapiens
ctggctccaaaaggaatctggaagcttattgggaaatggagaagcaacagcgccaccttcctcagccttgacacacacttgctcatgccctccctctttcccctacccccaagagatgcaatcataatagacggtcatgaatacctagaggacccttggaaggtttatgaaagagttttagggagtctgtgaagcctcacaactttatgcaaacatgtatgtgcctatttggaaaagagggggccacagctttaatcaaactctcagaggatttcataatccacaaaatgttaagcagctttagtctaggagggctttgg

SEQ ID NO: 394236 - DNA, 194 bp, Homo sapiens
tttccaggacaggatttcacctgttgcctgaaatatgtgatcctcccacatttgaatggaccaaaactatgtttgaaatatacagcaagatggccacctgcaaaccaggaagagagcccctaccaggctggtaccttaatcttagacttctcatcctgcagatttgtgagaaataaatgcttgttgttaaagcc

SEQ ID NO: 394237 - DNA, 212 bp, Homo sapiens
tactggtggttagcttgggaagaaagtgaaatgtgacttgcctaagaaagtaagacccctctccccatcacacccatatgtgaaagcttcttgggccattattcttttcatctcagccaatagcctctgtccttgctccttgacatacttcttgatgactggtagtggaccagcaaagtagttaacctgtcccaaaatcacacacgaagaga

SEQ ID NO: 394238 - DNA, 316 bp, Homo sapiens
tttttagccctcttcacttcatgtcctgaccagttttctactttggtcactcaccctgtacagacagactaactagaactctcagatgatagaaaaattcttaactacagtagcccattctgtgccctggaaaatggagcatagctgaatatttggaaatcttatggggaacaactgttattttgcacacttttgtcatttgatgtctgaggatgaatacagacaatggaagtgattgaatgaaatatgtgtccagcccagcatattcctaaatgttgcattagggaaaacaccttaccaattctgtgtttccctg

SEQ ID NO: 394239 - DNA, 1570 bp, Homo sapiens
tgctttgccagttatcccagatcctgcactcactgggagtccatcttgaggaaacactggcatggctgagtaattgatcaggagcagtcctgatgttgccagcagaacaaaggatgattgtgtttttcaaaacgcaactttctcagcacttcactccaaacagcagacttttgaggacagggctggaatttgttttgtgcaatatatgccttcatgaactaaggaatgttcatccccaggcagcatgcaggagggtctgtggggctcacctcctcaccttacccaccatcactcgcgcctagctctcacctctcagttgaatgaatagtgggagatcatttgacttttaatttatgagaattattttatgttatttatgtatataattaactgttttatacatagtagtctcatcaaatgaattcgggcttggggtgatattgtctccattctccagatacaagtgctccaggcatccatggaatcagcaggagaccagggctcctaagatatatttttaaaaatcagtatcgatttctttttgcctttgcagaatctaaagggcaaatgacctcgcagagactcccaacgggctttgggctcatgacgaaacacccactagcattgatcttttattcctcttccctataaaataaaggccttggaaatcacaattttatttttttaaagaagttgttttagtgcctagagtaagaccgcatcaaatgttgttaaagaacctaatttagattgtgtggtatataccactgtttatctcaatacacagacacctcttacttcttgttataagtgagaactctaaagaaaaatcaaactcccaagttttctgtaaacatacgtggtcttaatagggtcactgtctgaggcaaaatgggttgtcttaaagcaattgctacaaatttgcatcaaagaaactagatagcaaaatacaacaaccatgtaccacccaggcagaagagtcctcacctatacgcagttctgcatattgatcatcatgacaggaagtatttcgttttttaactgatcccaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggtacagctgctccccgtgaatcctggtctgtgggttgagaaggggctcgggcctctggaatgctctagcgtgtgacgtgttctcaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 394240 - DNA, 2372 bp, Homo sapiens
agggaagggcaggagtggtggaggtggtcccaaggcgtgtgtggcttctgggttcccacctgcatcagcagcaccctgacccccagctcatgccctgtgctcctcataggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttgaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccacccccgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 394241 - DNA, 2370 bp, Homo sapiens
tgctttctcttattagcgattggtactgcaaatacctttattgctctttgtagctttgtggtgggattttcatttaccaacagcagggcacttcagaggaatggatagaaaaggaagcatctgttttccgtctttttcgtgcttacttttttcaatttttttctagccagtgaaattaatttgtttcttagttccttctcattgccttcatgattgtgtctgtttcttgtttttgtttctcgctggaatttttccagaacaaaattaactcggtttcctctttcaccaaagaatgtcgtgcttctttggtgtggtaacacagagcgcatcctggggaggtccttgcgttccccattttgcaaaaatgaacggatttttgttgtgtgtgaatcttccaggtagtggtgaccctgggtgacccaaatgtgaccacaccatcgagctcagtcggcttgaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccacccccgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 394242 - DNA, 2219 bp, Homo sapiens
ggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttgaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccacccccgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggttggtgtatttcatgaccagttttctataaaaatattgaatga

SEQ ID NO: 394243 - DNA, 2608 bp, Homo sapiens
ggcatcaaggagtacgagtgcaaggagtgccaccgcaggttcgcgcagaaggtcaacatgctcaagcactgcaagcggcacacggggattaaagatttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttgaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccacccccgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 394244 - DNA, 2379 bp, Homo sapiens
tctgcaactaaaggaacttgccccgatccttagaaatacaagacccagctgtggtcactgtttcttgtggcagctcggtggcccacaagcgtccccactgattggagagtgtgtccagggcagtgctggggctgccctggccgctgcctgacgtgaccgactaacctggttctcggctgaaaccgatttttctgcagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttgaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccacccccgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaacgcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaa

SEQ ID NO: 394245 - DNA, 354 bp, Homo sapiens
agcaaagccccactggaatcttggggtggggcctgggcattggaatttttaaaatgcgcctcaggtgatgcggttgtgtgggcaggtggagactcactggctttgatggagactcttagggaaactttaacgaacatgtgggaatgctttgaggaagaagcaaagggcggcatgaggcactgaaagaaatgagtgcagctgcagaggaaccctcagatctgagttaggttttgaggacttctatgaaaaaatggaattagaagtcaagtaagccagggtgagtgggagagcagcaccagcctgttggttttagagcagggccaggagggttaacagcttcaggatatgccaagg

SEQ ID NO: 394246 - DNA, 366 bp, Homo sapiens
ctatgttgcctaggctggtctcaaaactcctgggctcaagcggtccttccgcatcagccttctgagtagctgggattacaggtgcacaccaccacacctggctaattttatcatttttctgtagagacaaggttctcactatgttgcctaggctgatctcaaactcttgacttaagcagtcttcctgcctgggactcccaaagtgctgggaatacaggcatgagccatcgcatctggccttgagcctcccttcttggcaggctgttagttggggtaaaatatctactgtttgtcgctcctacctattgcaagtcctgtggttaatgaccactatcgcctttgagagtttcattttcttttcttttt

SEQ ID NO: 394247 - DNA, 265 bp, Homo sapiens
actgctgagaagtgttgccttctcttatatttagaagaggttctgtagagtgtgtgctcattgtttgaatgtttcctggaattttccagtgaaaccatatggacatgtcaatttctgtttttgaagcttttaaatgacaaattctgtatctctggttgttagagaaccgttcatattagttcaccgcgagtcttggctgtgtggggttttgtggcattggcttatttgagctaacttgtggagtgtgtgtgttgagttgtttctg

SEQ ID NO: 394248 - DNA, 485 bp, Homo sapiens
actgtaaatgcctggcatttattctagactctttgataggagagatccttgctattccaatttaggtggctcacagatgatcaatgaatattgcatggttgggtgcgtgaatggaaagataaatggatagatggaagatgaaatgaacgaatgggaagccacactaaatatatgactgatttttgctgaacattctctccctatcctctcccctgcccaacctcaagaaaagataattacaaacactaggcaacagcaggggaaagaagaccaaaaaaaaaaaagaactttgataattgtatcagcaggataagagtgatcattatgaattttgaattaatgtagacacatttttttgatgtgagagcacttgtcaaaaatataaaacacacccagaataaaagtaggatgcagtagtggcttttcctaataaaaataaaatttgctgaagatgcatcttttattttttagagaaaaacatttta

SEQ ID NO: 394249 - DNA, 519 bp, Homo sapiens
aaataccacactccaccccaggagagtggtcaacaggcagcaggaaaaggcttgccccagctacgggtgcagctgcaaaccatgttgggttagaaaggtgagggtatcaggtgtggtggtagaagagttaagaaggaagaagaggccaggcgcggtggttcatgcctgtaatcccagcactttgggaggccgaggcaggtggatcacaaggtcaggagttcgagaccagcctgaccaacacggtgaaccctcatctccactaaaaatacaaaaattagccaggcatggtggtgcgcgcctgtaatcccagctattcaggaggctgaggcaggagaatcgcttgaacccaggaggtggaggttgcagtgagctgagattgtgccaccacactccagcctgggtgacagaccgagattctgtctcaaaaaaaaaaaaaaaaaaaggccgggcacggtgggctcacgcctataatcccagcactttgggaggccaaggcgggcggatcacgaggtcaggaga

SEQ ID NO: 394250 - DNA, 1225 bp, Homo sapiens
  misc_feature (1225)..(1225): n is a, c, g, or t
gggtatctcaagcctgtaattgggaggctgaggcgggcagatcacctggatcaggagttcaagaccagcctggccaacttgatgaaaccctgtctctgctaaaaatacaaaattagctaggcgtggtggtacgtgcctgtggtcccagctactcgggaggctgaggtgggaggattgcttgagcccaggaggtagaggttgcagtgaatcgagttcatgccttatatgtatacttgtgcttttccttaggatttcccctgaacagttctgttaacctgaattcctgtcctcctcatcttttgtataaagagccactgatggaacactgtgtctttcccttatgtgccatacctgttcatgcctctcaggaaccagaagtgtaaccctcgctcctactctcgacctagcaatctaatccttcttaagagatgttggaagaaaaattattgacactgaaattcataaaaacatgacatcccagaggttgcagtgaaccaagatcgtgccactgcactccagcctgggtgacagagcaagactctttccgcaaaaaaaaaaaaaacaaaccaacaaaaaccaaacaacaatctgggttagggccgcccgccggggcctctagaaaaaggcttttcttagaaccaatttcggtttaggcgacagcaggccaccccagataggtaaactgcggaccctcggcgccatagacggggtccccaagggagaacaccagggagacacaaccatcggggggttgggatctccaccccgaaagtaaaaaacccccccgggggggacacacagtcgcgtttcttggacacaacacccaggcagggactccagcgacgaaagacggggggcaataccacaagggggagccacaagggcgctcccagaaataaaatataacgccagccggggagaaaaacagacacacaagccaacaacaaaaacaacatacaaccaacccaaacaagcacacagagaacgacatcaaacaacacacatagcagcagcagaactacaacaccagaaagcccaacacagagagaatagcccaacgacacacacacaacacagagacaacaaacaaagcaaccacaatagcaagaacaccagtcaaatcaagataacacgataccacaccaaacgcacaaacactcataagacgaaggcgaaccaaacacaaccacgacaccacaaccacaaataaaaccacactacgaan

SEQ ID NO: 394251 - DNA, 259 bp, Homo sapiens
caagtctgagttcctgtcacacgggggtgtgggtgggccactctgaggtctcaatgactgcttctctgtggtcactccccagaaacagggctgggctggttgggtgtccccgagcagagcagggaatgggccagagaaggtccgtgtagaactgtgctgacatccacgtacccacctgacgcccagccccaccacctctctccccgtgagggtcctgtgtggagggcagccctggccccatcagaggcccccaatcatg

SEQ ID NO: 394252 - DNA, 758 bp, Homo sapiens
ggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaact

SEQ ID NO: 394253 - DNA, 784 bp, Homo sapiens
ggcgccggccgctaagaagccgaaagatgtccaggtcgggcgcggcggctgagaaggcggactccagacagcgaccccagatgaaggtgagaaacggactggtgcttccaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaact

SEQ ID NO: 394254 - DNA, 344 bp, Homo sapiens
attattctggggtggggtgtgacctgggttttggaacactgaaaaaatcccaggtgatcctaaagtgtagatgagtctggaaaccacacacctaaggcacacttgaatgggggagcagtgaggtggtgtgggctagccggccagaacccaggggtgggaaccaacattgcagatgccataaaggctgggaagcatagtgtctggggcccataacaatgcttggacatgaatgctttagacctaagacaattggctcctaaatgtgaaaactgcaaggctgaaatgaatgcatgtttaatgctttgcaacattgtcaagtggtcagctgcaactccgttctgagg

SEQ ID NO: 394255 - DNA, 362 bp, Homo sapiens
atctaggcaataccattcaggacattggcatgggcaaagacttcatgactaaaacaccaaaagcaatggcaacaaaagccagaattgacaaatgggatctaattaaactaaggaacttgtgcagttttatttgggagtgtgcatgaggtacctctgagtttcaaaaatgaagaaagtaagtggtcatgctttcctgactctttggtagacacagccttttaagacggtgattctgagctgttacggttttgggtttcctataatactgaagcttactgctgacatgtaatcaagagcttgaattaatttaaaaaaatcacccaaatgcacattaaaaacctcttacaacacatgtgcacatt

SEQ ID NO: 394256 - DNA, 320 bp, Homo sapiens
ctactgggtcttatgttgccatagacttttgtgtgaatgttcatagtagctaaattcgtaatagccccaaactggaaacaacccaaatgtccattgatatggtttggctttgtgtccccacacaaatttcatcttgaattgtaatctccaggtgttgagggaggaacctagtggaaggtgactggatcatgggggcaatttcctccatgctgttctcatgacagtgagttctcatgagatctggtggttttataagtgttcgaaagttcctccttcactcttctttcttgccaccttgtgaagaaggtgcttgcttcccc

SEQ ID NO: 394257 - DNA, 312 bp, Homo sapiens
ggtggctgctgctgctggcatatcattaaaactattcctagaatagacttattatttacgtgggagagccctcactgaatttccaccagaaacaagtctattctgtagctcattcgggttggtttggagtgtttgtgtgttccagggtgcatgcttatgtgtgtgcatggtgtgtgtgcgtgtggtgtgtgtgtgtgtgtgtgtgtgtgtctgtgtgtctgtgtgtgtggttgtcctcctgcagcctcagttcagcccagagccctgctggggactcttcctctcctggctaggagtgaggagacctctgcc

SEQ ID NO: 394258 - DNA, 381 bp, Homo sapiens
agtctaatatacccaagacaaccattgaaggaggacagtacctcgtatccactcaatcctgtacattcatcatatagtcagaattcatgatagtattttttgtgacagatagttcagactatcaagattttcaagaaaaatctctaaattggttttggtataaatgtagcagaagaaaaactaaattactacagtaatttatggctttcatttctggggtttccaagaaagttcctgtgaatcctggtatccgatttacttctcacaaggttattaccattcatttaattcacacagctgtaatagttttgttataaaaactagaattaaagttagggatatgataattatcttatttctcagcttgtttttaattgtata

SEQ ID NO: 394259 - DNA, 651 bp, Homo sapiens
tttgggtctcagctgccacctcccttccttggatgctgtcccaaccaccccattccaaaagaggttatcgcttgtgattctctatcactgggccaaatctgcctgttgcctagtgctcctagccctttctatattaattcatttcattatttcagccctgtctcctccactaggatataagctgcacgagagatgggctatgtctcttactcactgttgggcctcccaggacctcagcacagggcctgacacacagtaggtgggttaatagatactgattgaatgaaagaacaaggtgggtactaaaatcccccttttaaagaggaggcttggagttatgaggttgtacgagcaaagcttattccctaactaccacagtcccccccctgcagccagggccgggatcataccacaattccctgcccatcaagctgtcatgaatagccctaagatatcaggaagcacaaagatatcaatgccaggagggataggaggaggcggccaagaaaccccggaatttgtacttaaaattctggctacgcaaactgcttgcccaactttagacaccatgatgaatgatcaggtgctgcaaccatgaaacatgacgtaattagtgctgcactcttggctgggggttggcttggaggcccc

SEQ ID NO: 394260 - DNA, 421 bp, Homo sapiens
aacttcctctgggcacagtcttgcctaacttctccagcctatcagtgcttctcttctcagacagtttaacattcactttctgtttcatttgtggctattctgttgccccaaatagacttcgagtcctctgagtaccaagaccacatcatctccttctttacagacccttatctacaggcacgcttccaggatcagccctatacaagttttgcctggttgattgggttgagtctctagagtgaggcctgcaagatagcatctatgcgattcagggggtcagggtctctgtgagggaggaagggaagcaccttgtgtgcctgctgaactcctggcagctagcccacccacccaagaccagggaggacttgccagagcaagcaggtagtttggttggcgtttgccatgggcggttgtattttcc

SEQ ID NO: 394261 - DNA, 151 bp, Homo sapiens
ctcgagctcagtacgtagcgctgcatggtaactgccaggcaaaattaaagctcaagatgtctttaagcttctaatttagaagatgtttagaatagatattggagtcatctgtgtaaagccatggactcaccaggaagagaaccaaaaaggt

SEQ ID NO: 394262 - DNA, 226 bp, Homo sapiens
aaactgcctaggttcaaatccttactccattccttacaactgtgtgataatgggcaaactgttagcctatgactcagtttcttttcccagaatgggaatagcacctccctcagggttatgtgaagataaagtgagataacttgtttactcaaatatttattcatcatctgctatgtaggatactgttctggatgatgaaaacattagtgcacaagacagagtctct

SEQ ID NO: 394263 - DNA, 106 bp, Homo sapiens
gggtgtcaggcacatttcttcattcacattgcataccagagaacagtgtagatgctgggcagtgcctagaagatgcgagatctgactcgcagtcatgtctcagcat

SEQ ID NO: 394264 - DNA, 302 bp, Homo sapiens
ctatacctcagccacctgagtagctgggatcacaggcgcatgccacaacgcctggctagtttttgtatttttagtagagatagtgtttcaccatgttggtcaggctggtctcaaactcctgacctgaaatgatccgtctgtcttggcctcccaaagtgctgggattacaggcatgagccaccgtgcccggtatcatatttatcatttttgtatatcataataattagacatgatcctgttggtctcctaaatactttttgctactacatgaataaaatcagcatcattgagaggataagtaa

SEQ ID NO: 394265 - DNA, 207 bp, Homo sapiens
gccgcctgtaatcccagctacttggggggctgacgtaggagaattgcttgaatccaggaagcagaggttgcagtgagccgagaccgtgccattgcactccagcctgggcaacaagagtgaaactccatctcaaaacaaaaaagagattctcaatgcagtggtaatttccgacaatcctagcatctactcttcacttttcactgccca

SEQ ID NO: 394266 - DNA, 554 bp, Homo sapiens
ttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctg

SEQ ID NO: 394267 - DNA, 684 bp, Homo sapiens
aaaaagtttttctggagaattatttttgttatatgctacaagctaggcctactgggaaggccaggatccaaagacactcccaaagttgtgcaacgctcagcctgtgcaactgtacctgggagccctaagcagaggacagaagatggtaagtgggcagaagtaactaattgcaaaaagtcttccttattgggtaagttatctgggtgaataactttgggaaaccagttcttctgggggggcaaaggcccatgtgatcaatgcagaagttacccacagaagctgtgtgcagccactgttaaccaggagagagggtctcatagagagggaagaggcaaacaggatcccatgtgcaagctaagaatcaggacagcaaagctagcctaacaagggccaggtgtcaaaaggcagtgggctccaacagggctgctacctcactagtgtaactgacagtgtaactgacaggctgctgcttcaataactgcacgctaggcgtggtggctcacacccgtaatcccagcactttgggaggcggaggcaggaggatcacttgaggccaggagttcaagaccagcctggccaacatagtgagacccccccacgtctctaagaaaaacgttcaaaattagccaggcatggtggtgtgcatgtgtagtcccagctacttgcgaggctgaggtgggagga

SEQ ID NO: 394268 - DNA, 752 bp, Homo sapiens
aaaaagtttttctggagaattatttttgttatatgctacaagctaggcctactgggaaggccaggatccaaagacactcccaaagttgtgcaacgctcagcctgtgcaactgtacctgggagccctaagcagaggacagaagatggtaagtgggcagaagtaactaattgcaaaaagtcttccttattgggtaagttatctgggtgaataactttgggaaaccagttcttctgggggggcaaaggcccatgtgatcaatgcagaagttacccacagaagctgtgtgcagccactgttaaccaggagagagggtctcatagagagggaagaggcaaacaggatcccatgtgcaagctaagaatcaggacagcaaagctagcctaacaagggccaggtgtcaaaaggcagtgggctccaacagggctgctacctcactagtgtaactgacagtgtaactgacaggctgctgcttcaataactgcacgctaggcgtggtggctcacacccgtaatcccagcactttgggcagtttttaaggctgggtgcagtggctcacatctgtaatcccagcacttgggcagggcaaggcgggcagatcacctgaggtcagaagtcggagaccagcctggccaaacatggcaaaactctgtctctactaaacatacaaaacctagccaagccatggggccgggtgcctgtaatggcagctactcagaaggctgagccaggagaatcgctcgaacccggcaggc

SEQ ID NO: 394269 - DNA, 368 bp, Homo sapiens
tcccatctctgccagttgtcttcctgcttcgacagaaccaaccccaggcacaggcaccgaggaaggtgaccagacctgcagtcacttgctttagtttcctggggttgctgaacaatgtaccacaaactgggtgttaaacttcacaccacaggaatgtattctctcgtagttctccaggccaaaagcccaaaattcatgtggactaaatgaccaagattgtcagatggtggctcacatctgtaatttcagcactttggaagcaaagcctagaggatcgcttgagcctgggagtttgagaccagcctgggcaacatagtgagaccccacctctaaaaaaaaaaatagccgggcgtggtggtgggcgcctg

SEQ ID NO: 394270 - DNA, 269 bp, Homo sapiens
gttggtgggaggaatgagaacctggaggctgtcctagctgtctgtgacttgatttagcatagggggaaagggctgacctttttcctgccagcagtactgtcaaggcctgcccaggtggcagccgaagtagctcccttcatgcccactgcacaccacagcatggtggcaggggcgcctgcagtctgtgcacatgcacacatgatcgttctctgcaccccttatcggaactgcgggttgggcaggaagcagcatgaccgcagtgggttcct

SEQ ID NO: 394271 - DNA, 404 bp, Homo sapiens
ggctggctgcagggaagggacccagggtggagactggcaagctatgggcagtgagcctagaatgccccagagaggccagagcaggctcagcactgactgaagttggggcatgtggggccagagggcctggaagccaggggtgcccggttccacaggtgccaggcgcgtcccccaccaccgggggaagtgctgtgctccctctactctggagatcaggaccaggctggcctgcacccccaggggagcagatgcgactcactggctccctctaagagggcttcctcctcatctctctaatcaactgtccccatcctcaggggctcagagcagaaaggtggcccaggacacctggatgtaagggacgagcccacccctggaacccaggattcctgactcagcttgtg

SEQ ID NO: 394272 - DNA, 314 bp, Homo sapiens
attgtctgccatgtacccggcattgcattacgtgttagagtacattgatgaacaaaaccagtcaaggactactctgcaaggaaattatagaccagcatgaaatacattaaacatgatctcaaatgattaggcaactacagtgattgaggactgtggtaaggatgccttaattgttgagttttcatactcagaactctgacgttcagcacttttttttttttttttttttttttttttgacggtgtctcgctcttgttgccctggctggagtgcagtggcgtgatcccagctcactgcaacctctgcctcctggg

SEQ ID NO: 394273 - DNA, 218 bp, Homo sapiens
cactataaagttatacagcaattccttctacatctcaattattaagtattactattgggagaggtgtatctctacaaaatttaagtaatattcataataaaattaccaaagagaaaaatagaaaaaaaaatttttttgaggcaaggtcttcctctgtagcctaggtggctttatttgtctgatccctatcctgcctgccaccctcactccttcaccca

SEQ ID NO: 394274 - DNA, 411 bp, Homo sapiens
gctcggtttccaggaccagtcttaacatgtggatcttgttgcttacacattaagacaaaatgccaattttgggggctgggggaataaggcatcaagtttgccccatgtgtagattcactcgtgtctgaccaagtgcaccctcggagtgttgcctacacagaggctggcttttccctaacgtccttcttttccgcagatcttcagaaaggctttctctgatagggcagtatgttaattcctgtgattgctgtaacaaaatacctcaaactggggggcttaaagcaacagaaagttgtgctctcacagttccggagtccacaggtctgaaatccaggtgtgggcagggccgtgctccctccgaaggctctaggggaggatccttgctcaacttatttttaagactggtcctgc

SEQ ID NO: 394275 - DNA, 135 bp, Homo sapiens
ggattcagtttcctgaagtgtcaaatcaatgaggtggaccagagcttctgcagctctagcttcctaccctgcatgattctagaacctgcgtaactccagcatggctggaaatggagcccgtgaatggtgggttgt

SEQ ID NO: 394276 - DNA, 187 bp, Homo sapiens
aaaaacctgtagtcggcagaaatgtcttctatattctgatgatcagctggctatcactctggttttagcattgtcagttttcatcttttttatatgccttcatatgtaattatgatggaaagctgggagaaactattactggggcaagatgtatttttcctgtgtaactgagatgaattgttagttt

SEQ ID NO: 394277 - DNA, 132 bp, Homo sapiens
gggtatgtcattggattccattttaattaatggatgaggctgacccatttcagagagcctttttaaaaggaaactttagactacccactggagagattcttaggaagattcccataggatgagtacaaagtt

SEQ ID NO: 394278 - DNA, 223 bp, Homo sapiens
cacacctctcttccccacaatagggtagccttgacagatgatcctaattctcctttgatgacattttcaaacttacaaagttgtctaataaggatcattatgcacttcagtgtgagctccattcaccactatactgctcacatagctatcaactaacaagaaatgttgaggactcatcttttcaagaattacaatctatacaacccataatagtgttaaagct

SEQ ID NO: 394279 - DNA, 477 bp, Homo sapiens
  misc_feature (2)..(3): n is a, c, g, or t
gnnacaggagttttgttacccaggctggatttcggtggtgggatcttggctcactgcaaagaaatgaacaaaaattcaggcaacgtagtgagactctgtctcctgcggttgatacctgttctacctcccatggctactcttgctcccttcccatttgcaggggctgttaggactccactgaacagttcagtgcctttttattgagtgcctatgagatgccaggccctgtcctgggtattgtgggcactgtggagcgagatgtctttgaccctaaagagcttttattccagttcagggagagagactaggcgagacatgaaatatacagggtcacaggagtctcagtggactggggtcaggagaattgcttgaacctgggaggtggaggttgcggtgagccgagattgcaccagtgcactccagcctgggcaacaagagcgaaactccatctcaaaaaaacaaaacaacaacaacaat

SEQ ID NO: 394280 - DNA, 512 bp, Homo sapiens
tcagcattgtgttataatctgggaatacaaaaagtatttagaaaaaaatgcctatatatttgtctccctcagcagaattgagttcttctagagtggataccctgcctgccttattcacaactgggtctccaacacctagaaaaatttctggtatacagcaggcactcaattaatgtggcttgattagataaatcaggacaatcactgtcttcaagaagattaaagtccagtggaggagaaagatatgtaagcacaatgaagtgtggtaagttctgtgacacaggaaatcataaaactatatgtcaacaaacagagggtgggcgtgagggaggagtgaataaggcttccaaaagatgatgcaatgtgggacattaatggatgaacggaacattgcccatttgtgccatggttctcctcccctattcttctctttgaggattctagatttcatgtgttctcttttgatggcttgggacaatgggcagagatgagcactctgggcctgctgtgtc

SEQ ID NO: 394281 - DNA, 248 bp, Homo sapiens
agagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttc

SEQ ID NO: 394282 - DNA, 297 bp, Homo sapiens
cccccgctccaggctcaagcaatctctacctcagcctccctagtagctgagactatagggacatggcaccacacctggctaattttttgtactttttgtagcagatggggttttgccatgttgcccaggctggtctcaaactcttggtctagtccagtcccctcaaaccccaggcatgcggcccacaagggtaagagacttggtcaggagtagagttcagaccagagttcagagcccttgatttcaaattcaaggcaagtttgtttacttttgggaaattcctagagaggagaatga

SEQ ID NO: 394283 - DNA, 528 bp, Homo sapiens
tatcaggaaggccgcccctctcttggtggctgactctgtggctctgtaatactaggaaggccgcccctctcttggtggctgactctgtggctctgtaatattaggaaggctgcccctctcttggtggctgactctgtagctctgtaatatcaggaaggccacccctctcttggtggcttgctcaccagtccttgaggttttatttttaaaatgagccctaaagaagcacatgctaacacttagactataggggtggcttttccatgaaagcaggatgttttgatctagctcttatgatacctaacacttgtttcctctgccacgtgtaggaacacttagtacacaattcacaaaatgatcgagagcagatggaagaattaggttagcaaaagattagatccgccctggacaatgggggaatcctggatatagcatagggacattgccctcaatttcataatgggttagctaaagatacatataagttagcattagtttatgcaattcataatgaatattgccaattga

SEQ ID NO: 394284 - DNA, 1054 bp, Homo sapiens
attagggagggccatgtgctgtattcagtctactgactgaaatgttagtctcttccaaaaacaccctcacagacacacccagaatactgtatgaccaaatatctgggcatcatgtggcctagtcaagttgacacataagattaaccatcacaatgaggaaaaacagaaatgatacatgtatacagagtgctcctcatcccaattaagtttcaccaagttaataatgtgtctctatgagaagtggttcaccatgttggtcaggctgttttcaaactcctgacctcaggtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgttggcttgggctggtaccctgttattctctgtgatgaagggattcactggaggtaaaaacgtaatcatttccaaaggttgagaataaatgactttgaggaaagggtgttcattatccgttgcttctatattataatcagttgaactacaatacggttatctattgattttttttaatttttctgacaaattattgacaccaaattgaataattcatgacctgcatgcttcagcttctttctccctggtttccaggtgctattccctcaagaaatgcaaattaaatatgtcggtcttaataaatcaggagggaagcataaaaaaaat

SEQ ID NO: 394285 - DNA, 887 bp, Homo sapiens
cctcccaagcagctgggattacaggcacctgccaccatgcccagctaattttttatatgtttagtagagacaaggttttaccttgttggccaggctggtcttgaacttcctgacctcaggtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgttggcttgggctggtaccctgttattctctgtgatgaagggattcactggaggtaaaaacgtaatcatttccaaaggttgagaataaatgactttgaggaaagggtgttcattatccgttgcttctatattataatcagttgaactacaatacggttatctattgattttttttaatttttctgacaaattattgacaccaaattgaataattcatgacctgcatgcttcagcttctttctccctggtttccaggtgctattccctcaagaaatgcaaattaaatatgtcggtcttaataaatcaggagggaagcataaaaaaaat

SEQ ID NO: 394286 - DNA, 858 bp, Homo sapiens
attagggagggccatgtgctgtattcagtctactgactgaaatgttagtctcttccaaaaacaccctcacagacacacccagaatactgtatgaccaaatatctgggcatcatgtggcctagtcaagttgacacataagattaaccatcacaatgaggaaaaacagaaatgatacatgtatacagagtgctcctcatcccaattaagtttcaccaagttaataatgtgtctctatgagaagtggttcaccatgttggtcaggctgttttcaaactcctgacctcaggtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgtgctcgggacgatggtgagaatagacacattgagtgatattctaatgtgtcagagatgggaggatccacgctataaaatagacatgccgctctatatctctttcctgagtgtacacactgcctgttatac

SEQ ID NO: 394287 - DNA, 671 bp, Homo sapiens
atggaaggtagttgcctgctgtggtctaatatgtgaatccctgctgggattacaggcgtgagccaccacacctggcctggtgccatgcccggcctggctggttatttgttaaagcactggctttgctgttcagtagagccttggatttgccggcttctccctgcagcccctggctcagtgagcaggcacacgtctcggtcccttcaacatacgttgagtggagtctggtcagggtagtgtcctaagtatgtttctttcagaaaatagcttgaagaaaatgtcagagtaacatttgtttctccattaaaagcaataaactctcaaaagtaggatttctggagttgaaaagtaaactgaaatgaaaatatcactagacgagctcacagcagaattgagcaggcagaagagtcagacaacttgtgaacacaggtcacctgagatcatctcgcttgaggaacagaaagaatgagtaaaaaaaattaacagaaatctgtgaccccctcaagcacaccgacaccaccccatacagtggcattccagaaggagagcagaaacgatgggtgagaaacagcctgaccatctcagtggatcagaaacacggatcttacatccagggagctcggtgaactccagacaggtgaactcggagaagagctgcgcttagacaagtg

SEQ ID NO: 394288 - DNA, 539 bp, Homo sapiens
aaatcatttggggccattactgtaacatgctgccacaactaagtaggctttgaaatctgaggtagcctgctagcacactctgaacacattgctttttttttcttttctttcttttgagatagggtctcactctgttgcccaggctggaatgcagtggtttgattacagctcactgcaacctctgcctcctgggctcaagtgattcccccgcctcagcctcccaggtaaccgagactactgcacatgccaccatgcctggctaattttggtattttttgtagagacagggtttcactgtgttgcccagactggtcttaaactcttgggctcaagcgatcctaccaccttggcctcccaaagtgttaggattactggcgtgagccactgcgtccagcacaaattgctttttttaaaagtgtccttacatatactgaggaaagcttcagcataccaaaggatataaaggtacagattgcgtcaggcacagattggggtgaggaagatgcagtcggggatctctagagtgaccgctgcatccc

SEQ ID NO: 394289 - DNA, 229 bp, Homo sapiens
aacgatgagaaaatcaaaccatatgctggacatcattctgcccagctgggctgagtcagaattgcagttcaaactacttctgctctccctgggtttcgtgtgctttcaatgtggggatatcttccagatctgcagttctccagagctagggacccctcagctccagctgctctctggacaatacctgaacatccctacaatatctgaaattgaatgtttgccatttctt

SEQ ID NO: 394290 - DNA, 207 bp, Homo sapiens
tctccttaaatcttgctggtgacataaagaatacttagtgccttataatacagacttctgcttcacagaaaaatttttcatttgttttgtactggaaaactgcaaatggatacccctaatcatgcagttgggggaagtcacttcagaacagggagatggccttattgagacctaatatgagggacccaattcaagtggtcctttgat

SEQ ID NO: 394291 - DNA, 250 bp, Homo sapiens
ataatagagagcatttgggggacattagtggcagcacagcacaaatgaagccagtgcgtggcctgtctcctccttgcacggtgcttctggctttctgctggttaatacaagatgccatggatagatgctcttggcaaatgtcccttgggctgctggctgttcacattgcccttgaaatctgaaatacacaccctagggattgaaaactgctggaggcttcatgttcatggagggaagctgagctgtattg

SEQ ID NO: 394292 - DNA, 424 bp, Homo sapiens
tgtaatcctcatgttttgcagacaaggtagctgaggctagaagagattacgggacttccctaaaggtgcacagctaggaggtggcagagttgagataagatctatccataaaatctacaaaggtagtatggaataatgaaatgaggactgaaggaggagtccagaaacccacaatgtagatttagccaccacttaggtgagctagatgtgttactttatttaacttttcggtcttcagtttatctttttactgagaagattggttttaataatgcaaacaccattctacaaaagtagggataatctacacgacagatttttaagattctgaggttctttcaagctctgaaatgctgcatattttgcctcaagcttgaaaatgaaaggtctatataatgattttcaacagtcacgttactaatgg

SEQ ID NO: 394293 - DNA, 352 bp, Homo sapiens
aataaattactcgtaactgtgcctgagcatgtttcctatagaaatgggtcaggacaggtggaatcgttggtagccgtgtctgacctaacactatactaagaccagcctccagccccagcccctcaccaacgctaagcatgaaaccaattttccgtctacctaggagcatgtgtttgatatcactgcacacccagggcacagagcttcggcattacaattcttggagcgtgtctgtctcctcgtgggtcctgtccagacctccagtcactcacagagaccctcacatgaccagcacccagggtccgactcccccagccaagcccagcgctgaccacaacctgcagccagcgcc

SEQ ID NO: 394294 - DNA, 539 bp, Homo sapiens
ggctcaccctgcttcagaacaagggccaacatctgtccatacccctgttatagtgagatgggaaaccttgtagatgttggcactgtgtggctcttttcttttatatactgggctttagggtcaatcccatttaaccaaagggttcaatagctataaaaaggcgttgaaattgtatggttatttgagttatagctcagtaaaggcattaaatcttcagcctagatgaccctattcctccccactctaaccagctgtgactccagatggagacattgccctgcatcctctcacgtccccatcccccacatcccacccagaaacaaatgtgtgagtttcatacaacaagaatggggggttaggagtcaaagtaagctgggaatacaaaaatggggcgggcgtctaaaatcccagctactcaggaggcaggagaatcacttgagcctaggagacagaggttgcagtgagccaagatcgtgccactgcactcccgattacagtcctcattgccctgggcaatagagcaagccccgtctcaaaaa

SEQ ID NO: 394295 - DNA, 354 bp, Homo sapiens
ggctcatgtgatcctcatttacttgaaggaaggcgctgagaagcactgcctggccgggtgcggtggctcacgcctgcaatcccagcactttgggaggccgaggcaggcggatcacctgaggtcaggagttccaagaccagcctgactaaaatggtgcaaccccgtctctactaaaaatacaaaattagctgggtatggtggcacatgcctgtaatcccagctacttgggaggttgaggcaggagaatcacttgagcctaggagacagaggttgcagtgagccaagatcgtgccactgcactcccgattacagtcctcattgccctgggcaatagagcaagccccgtctcaaaaa

SEQ ID NO: 394296 - DNA, 395 bp, Homo sapiens
atatgtttattcttatgtgtattttaaaaataattagtgagcagaacacaaaaagcactagtcataaagaaaaagattggtaatttgaattgattaaaatgaagaactaatcaaaagacaccattaagagggaaaaaaggcaaaccatagagagggagactatatttgcaatcctcatgttaaacttcgagcccttgtcaagaatacatgcaggctggtggctcatgcctataatcccagcactttgggaggctgaggcaggtggctgtctgaaataataataataatttttaaaaaccaaccttctgctggtctatatttccttatgattgaagtcagtttgaatcatggtttctgtcccttttaactgaaagcacctcactagtaggacctta

SEQ ID NO: 394297 - DNA, 361 bp, Homo sapiens
tgaaactgtctctattaaaaatacaaaaattagccaggtgtagtggcacatgcctgtaatcccagctacttgggatgctgaggcaagaggattgcttgaacctgggaggtggaggttgcagtgagccgagatcgcaccattgcactgcactccagctggggcaacagagcaagactcctcatctcataaataaataaataaacagacaacctagacatggcaaaaactagtataaacaaaattgggactccagtgataagctgggaagaaatagttgccatgcagcatgttcaaagggctaatttcctttaaaaagcaggatcgcttgctgatagaaaagaccaacaactcagtagacagg

SEQ ID NO: 394298 - DNA, 264 bp, Homo sapiens
acaaatcaatacacattttcttaaaatctattgtggagctgtcatgcttgactgctttgccaagatttaacctgcaagctccaactttgagctctacattttgtgaaatatgtttttttgcctcgaacaccaaagactaatgtttatacacattcagtgttaatattaggatgtctaaagtttctatgcttgctatagaatatgtttttacagtttcatttaattcatgcatataaattattctcatcacttgctttaattaaa

SEQ ID NO: 394299 - DNA, 527 bp, Homo sapiens
cggctcggacctgattgctgtctcaaggaagagtggatgtttgctgagtagacaggtagggaaagaagagacgtcctgcacaccgagaagcatactgatgtgctttgtggaataactcactgcaggtcatccagtgtgcttgaaactaaggtgaaagttgtcaggagctgggatggaaaggcctagagccggtccaggaggcgctcccagcctgcagaggcgggctgttgtagctggcccctctggagcacaagcttctctgtgaaaccaggtttgtttcatttttccccaagactttgttgcagactgatagtttataaaatgtaatgcagccctataactagaaatacgaaaactacagccctcaaatttctttaatattaagatttgagagacataaaattagtctatcgaattgctataaaagttttaaatgttcattctcagtttctgtacctagcttttggggactaggaacacctggtgctcgaacccctctggatcacacttgggtagcaccgtgctag

SEQ ID NO: 394300 - DNA, 191 bp, Homo sapiens
ggtacggttagttgtaaggtatgtgcagtcgatctcaggcaagcgtttggggagaattcttgccaaaagctcccacactgagggtctactccagtccgtggttttcagcgcattcgcagagttgcgcggccaccaagtcaacttcggaacattttcctgactctagaaagaaccccctagctcttagtcat

SEQ ID NO: 394301 - DNA, 689 bp, Homo sapiens
  misc_feature (689)..(689): n is a, c, g, or t
tggattatatgacagattggttaaaatcattatacaagggaatttcttgtaggtttttaggatgtaagagaaaagacattataattttatttttgtttcacatcagctgatattgatggtttaaaatatatttttattccttaataacatttaatgataagcttatgtataatttgtaagtaagtcaagaagagaatgattttctgccagtgaatatacaacataatactatagcagtgtagttaggtggatgtgtctctagcatggcttttgtttaaataaaggacctcagaggtgttgcgtgtaataggccttgtggctgggcgcggtggctcatgcctataatcccagcactttgggaggtcgaggtgggcggattacaaggtcaggagttcgagaccagcctgaccaacatggtgacaccccatctttactaaaaatacaaaaagaaagacaaagaaaaaaatgttgggcgggcggccatgagcctgagaaagagggtctcgagaccattccgttgggggccgggccccgtatgttatggacactgggccaagctgggccaagagaacccggcagacatgggctgcgttcccacaataaaaacgccggggaaccggggttctgagcacccagggggtccgagcaaagggtcaaacaggggaaggggccgtatcgcgcgggggggn

SEQ ID NO: 394302 - DNA, 673 bp, Homo sapiens
caaaatgactgatcgatgttcttcagagccattacaatcaggaagttttaggaagaacaactgaacagctatggggttggtctctggagtccctcctaatagctcaagggcattttctgcctcttcccaacctgtaaatggaccacaagggtgaccataggcctatggcaggttcagatggttgagggaagccttcggcatctgtgcaatgcagccactggccacccaggagcaagctagatactgcatttactttgttgctgagaagcacctgtctcttaggttagattttcaagagtgcatttgtttgcttcttggctaaagtcttctgcaaagaccatgctgaaaagagtattcttgccaaggaaaataattagtggttttggcttccacaaaattatgacagaaaaatatgaccccactgtgtttgcctctttgttctcagagaaactaaacatgcaaggttttataacagatatttcaactttacagattccaaaggttgtcttcatgtgtaattattcagccttatgttttaaaaccaccttaaccattctttaaaagagaagtcagcaaactttttttttttttttttgagacagagtcttgctctgtagcccaggctggagtgcagtggcacaatctcggctcactgcaagctccgcctcctggg

SEQ ID NO: 394303 - DNA, 509 bp, Homo sapiens
tacaacccaatacacttcatctatatatgtatcaacccaaacagtacagtatttgagacaaagctctcaacctagacttgggtttgaacccaaattttgtgggctagtatacgaccttgagtaagttatttaatctctataagctttaatttccacatttgtaaaaggtggttatttaaaggagacaatgtgtgtaaattaccctttgcttaaaataaatgcccaataaatgttagctattattgactgaaaaatcatatcaggtggccctaaggtaggtcagatttaaacctttgtccagttatgtaattctcataaattcctaatagggttggtatgagaacaaagtttaaaataaaacaacaacaatacaacgaacaagaaagcaagaaaattaagaagacagaaaaagagatgaattaagcagtcaacctagagtcagaattggtatctggagaatgttggtgtcatccaggtgactccaacaaaacttcaggctccatctgaca

SEQ ID NO: 394304 - DNA, 268 bp, Homo sapiens
tgtttctgctgatacaatattttcaaaaattttgtaggtcttctgtgtatgtcatggggagtcacacaatgagccaagagggtcctccacagatatttcttggattatcccatctcttttcctggcttctgctgaggtgtttgagtggatttataaatcttataaatcctataaatgcttgtctagccgtccattttgctttttctccagagcacactttcctaacagtgaggttaaatttagtgttctttgcaatctggctaggctg

SEQ ID NO: 394305 - DNA, 420 bp, Homo sapiens
attgtgccattgcactccagcctgggcaacagagtgagactccgcctcaaaacaaagaaacaaacaaacaacaaacaaacaaaccgtcatcctgactggcatggcgtggtatctcactgtagttttgatttctgcaacccatttcttgaattgagttgatcttgagagtttccttggacacgggaagccacttaatccagatttcctatttctgttgatccacattcctccagcttgaaagcctttttctgggggaggaaaacaaccttcttcttaaagctgcatgaaattttgctgctcccaaaggcatcatttagtagctctgccccaattattgttggccacttttcctcctggaaactgtttttctctgtcccacccttccccctagttccaaatgttaggctgatgttcttcttt

SEQ ID NO: 394306 - DNA, 309 bp, Homo sapiens
ccatagttttgcctttcccagaatgtcacacccttggaatcatacagcatgtaaccttttcagattggcttcttttacgtagtaatatgcatttaggattccttcatgccttttcctggattgatagctcatttctttttagtcctgaataatattccattctatggatataccacaattgatccattcacctactgaaggtcattttgattgcttccaagttttgataatttaaaaaattttttaagacagggtgtcattgtgttttccatactggtctcctgaacacctgggctgatgtgaacccct

SEQ ID NO: 394307 - DNA, 210 bp, Homo sapiens
  misc_feature (15)..(16): n is a, c, g, or t
gaggactttaggatnngtagatcccaatacagatgatccaaggaccactctatgagaagtctaccctgttgctttcctcagcattcctgctctcaatctgggaatcaacctgaaagttgacactttctgtacctgagctgcattttatctatgtcttcgtcagaggtaaaaggaaacaaaagaaaacaaacaaacaaaaaaaaacacaga

SEQ ID NO: 394308 - DNA, 335 bp, Homo sapiens
tccagcacaattctaagcccatggtagagagatagtaagtggtagcttttgtataggttcagttaatctagatgtttcttcaataaatgtcagatctctctggaaaccaaagtaagcccatattgttcaagtttcctgtgctgtggaaatgtcagcattcttccagaatagcatgatgtcctaagcatgccaatttgccaattgctgcaaaaaacatccaccagctggctcctctttcttccgcatttaattttagatgagttattgtaatcgaatacacaagtctgggtatagttacgtgtccctgccctcctgtgtggatcataagtagcatg

SEQ ID NO: 394309 - DNA, 147 bp, Homo sapiens
cctgagtcaatcactgttgactgaaaggggatcccatttcctgagccatctggaggtggggtgggtacctgaacagagtggaggctctgtcaggaaggaaggagcaggaaccagaggccgggaaggttcccagcagggcctgaggtg

SEQ ID NO: 394310 - DNA, 487 bp, Homo sapiens
cctcatctaaccacctgcatgtccatctagggaaaccacggcccagaggcgtcagactgaaccccagatctctgcacacccaacccaggctcacaacataatacaacttgctctcctgtgggcttaacagctacgctgattgcaaattctttcctattcaccacaaaacatcctttagggaaataaactttatttctttgacgatgggcagtaattcagaggtatccgaatttcagcgcaagacctgatctgtttccacggtacatgtgtttccactgactcctcctgggtgccccgtctattggaaaaggcatcagacgtatgagcaaaccacaaagacacgcaacaccacggtggaatctcgcaaggatgatgaaagaatctgaggtcacatggtagaattccatttatgtaaggttcaaaaggaggccacattctgaagccaggagatggaacggcggttatcgtggtgggtcagggagagtgg

SEQ ID NO: 394311 - DNA, 397 bp, Homo sapiens
ccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgcctagcaactcaagtctgaagaacccccaggcaggggtgccccctttcagctcgctcaagggcaaggtgaagagggaccggagtgtgtctgtggactctggagagcagcgagaggctgggaccccatccctggattcagaggccaaagaggtggcgccgcggagtaagcggcgctgtgtgctggagcggaagcagccgtacagtgg

SEQ ID NO: 394312 - DNA, 472 bp, Homo sapiens
aacaagcccctactttttaatacaaactgacaactgaggcaaatataataattccacaagcatttaatgagcacctataatacgactcctatcacaaggatcgtgcagtctagttgagtatttctcaaaagcttttgacctgatctacaataacaaataccttgtttttactttgttttgttttgttgttgtagttgttgttgttttgagatggagtctcactctgtcgcccatgttgcagtgcaatggcacgatctcggctcactgcaacttctgcctcccaggttcaagcgattcttccatctcagcttcccaagtagctgggattacaggcaccctccatcatgcccagctaatttttgtatttttagtagagacgggttttcaccatgttagccaggctggtcttaaactcctgacctcaggtgatctgcccaccttggcctcctagagtgctgggattacaggtgtg

SEQ ID NO: 394313 - DNA, 395 bp, Homo sapiens
ttctcttttgtagatggcctaacttactaccttcctccaggaagcattccctggctgttccatgtcatggtcatcttgacctctcctttctatcccactgtgtgaggacctgagtctaccctgtggagataagccaggtttcccttttctttttttttttttaaaatgtaaactatttggacgaccaaatggcttacaacatctacacaggtggctggtccggttgggtttggtacaaagtcccaaatattggcacacagggtgtattattctaaatagtctaaataggaagaagatgcttttaaagatggtatacaggccatgcatggtagctcatgcctgtaatgcctgtacctttttccactatgtgggccacgctagtgaagggaagtccg

SEQ ID NO: 394314 - DNA, 230 bp, Homo sapiens
tatgaagacacttggaatatttattcagtcttggttaaggatgtatggggttggggtcaattttaacaaatgtgaatgcatttgccaagtgtttttcagtttcaaaattatccaagcaccaaatgatgaaatagtccttaaaattatttaaaagtgtttttagtaatatgtactgaattcaattacagtaccattgcatgctgaaaaaatcccttgatgtgtgataaatt

SEQ ID NO: 394315 - DNA, 337 bp, Homo sapiens
cactgtcattttcataaatctgcccattgcaatagcttcttggtatttctgcctccagactcagcctccgccaaagactttttcatattgctttagaataacttttagatctcagaaatgccacatgattccatgcccactttagattaagggacagggatcccaacctactttgggctcttgttctgtccttcctccagctctgcccctcacagtggtgcaaggaatgtacaaggccttcagaatctggccacccagggcctaccacacatttgctcacaaactataatcccctcagcacgcctcaggaagcatctaacatctgctggagcctctc

SEQ ID NO: 394316 - DNA, 237 bp, Homo sapiens
gaggaaaaatcagcaggacaagctgagccaggaggagccagtgaggtgggaggaaagtgaagagtcttggaagccaagtgaagaaagtataaagtaggaaggaatgaccacattctgatgatggagaattgaccattgtatttaacaatagggaaaagaccatgacaggaggggtttgggttgagtggtagaatccaaaccttattagaaaggattcaaaacagaatggaagaagag

SEQ ID NO: 394317 - DNA, 348 bp, Homo sapiens
gtagatgactggagtgataggcacgttgtaaatctgatacatgaaaaaaatgaaaacttggagaagccttgaaatacacaaggatggcaagtactcagtatatttaggcagtgccactctagtgagagttgacagctatacccagtactgaagaaaagtaatgtcaaattattctgaatacaatgagacttggaagggacattgaatgtagttaggaacataacgcctgtccatcagagagcaatactgatgcatgcaggcgccctaaatgaagggaaccagatgaacgtcaacaagtatcgttcataaaagctaaaactacgtttcggtggctttctcatggaaaat

SEQ ID NO: 394318 - DNA, 441 bp, Homo sapiens
tgccaagtaggatctatctatagcaggccagaaacaaatttggggatatatatataaacttaaaggtagtagtatatattggggagagaatggactatgcaataaaatggtgttaggataactttaataaacacacaaaaagatactaaaatttattaacagaatagatgaaaaacagtagtaaaatagctttttaaagactatctatttgccaaaaatttaaaaactggcagttctggaaagtattatctaacaaaaaaggtagcacaagggtgaaaagtagcaacaaaaaagataacactacagtctcgaagaggaaaaagcatgctgaagttcctgtatctgttcaaagacaatgtgtgcgtgttttgtatcagagactggaatagttgtaaatagcgagatagttgtaaatcgcgagatagttgtaaattgggtacc

SEQ ID NO: 394319 - DNA, 218 bp, Homo sapiens
gaggcaaaccatccattttatttagagggtcaactgcctatcctttgcatatgagtctaaaccttacagcatataaatcttttcaattgacagtttaaagattagatttactacagatgtacacaaagcagtcaatgtatgtaactcctgtgactctcattttaagtcattggacaaaataatttcactgaagggatgccgtggaaggaaaccttcct

SEQ ID NO: 394320 - DNA, 550 bp, Homo sapiens
accccctccttcattcccaaagcccttcgctgataccaatatccttgtccatttcagagatggggacactgagggttaagcaaggaatgtcattagcctgaggtcatatagtgagttagtgatagggctgggccacaaatccactttttgggttcccaggtcaatgctcagcccaggctgagagccatcgatggtctctgagcagaggcatgactgagtcagttctgagatatagggaaaaaaatcctggaagatatttgaagagaaagttaaagacaggaatgggagagaaacaagagtgttcaaagaagagttaacatagcaggcctggaattgttatccttagaaaaggcctgcttgtaaggtcagcctgtggctggtgtctgggaacttagctgggaaacagttctctgcactgttgtaaatctttccctaactgataagagtggctcgctatgcctggactgtttgtacaaacaatctggtttatgctgaacatctgctttccttctggaagtgtgaaattctggtgcatgctaggcaaagggta

SEQ ID NO: 394321 - DNA, 441 bp, Homo sapiens
ttcagtatttgttgcgatatttaatgtgagactttacatgccactgttgttggtactgaagatacagcagatatttaatgtgagactttacgtgccagccactgttgttggtactgaagatacagcagagaaccacaacagacaaaaatccctgctctgggctgggtgccgtgactcaagcctgtaatcctagcattttgggaggctgaggtgggaggattgcttgagcccaggagttcacgaccagcctgggcaatatattgagaccttggctctacaaaaattttaaaaactagctgagtgtggtggcacacacctgtagttccagctacttgggaggctgaggtgggaggatcacttgagtctaggaggcagaggttgcaatgagctgagattgcgccactgcactccagcgtgggtggcagagcaagaccctgtctc

SEQ ID NO: 394322 - DNA, 413 bp, Homo sapiens
aacataacagggaagcaggtttttgtctccatccaaggagcaattttcatataacccgacccatcagtggatttggcatcattcaaaggagtgagctgcttttcagtattgtgtccagaaaaggcttgtaagtcacttgccaggaacttcaaggatgagatggctgcatggtgaggaagaaaagctggcgaaaggaggggtgttaaggctccttctaaacagaagatgctgtgatttatgctgaaacacagaactctatcccgcacctcatcctttgccactgactattgaagctctttgaaaattgggaaaaaaaaactgaagactgaggaaagagtttggtttaatgaaggaatcatttacggtctcttgactgaaagaaatgataaatttttaattttttcatggccttt

SEQ ID NO: 394323 - DNA, 216 bp, Homo sapiens
aatttgatgcatcttagatccaatgtgagtgattgaaacttacaagcagacttgttctcctcctccccagccccctgtctgtctgtctctctctcttttcctttcttctactctgtgccagatactgttcttggcactggagatgtaacacatacatacatctctgccttcatggaacttagattctagtggggcggacagactttaagcaaatgc

SEQ ID NO: 394324 - DNA, 371 bp, Homo sapiens
gtaagaaaaaagctacgaaaaatacgaactttcaaaataatttgaaaaggtattatttgcttattttctcttcagttgagaaattgagtttttaaaaaatgttattaaaacaaaacaaggcaaaagaatgttagccacatggcatcttatctacccagaaatcatcagttaataccctgctataaatccatccagacccttgtgtgtagacatagaaacaaaaatgagttcttcctacaggttctaagagtttgtcactaagattataattaacatctttccatgtgaatgtatacatatttctgaaataccattttcagaaatacacatttaaaatacacattttaaaatttgtatttcaagctaaccct

SEQ ID NO: 394325 - DNA, 479 bp, Homo sapiens
ccagcttggtagccactaaccatatgtggctatttacatttaaattaattaagtaaagttaaagaaatagggtacagtccttcggttacactggccacatttcaagtgctcaataatgaactgtggctacgactgccttacaggctagtgcagatatagactgtttccctcatcacagaaagttacatggggtggtgctggatggtaatttctcggaaatgttcaaagactggctaaatactgttatgatggctgtaagtagtgtgaggccaccttttaataacatgcaaaggtattgccactgacttagtacaaaaaggagacaggcatcacctgatttttaaaaaatgttttgttttcactctgtgcctatttgcaagctagtcaattcatctcttcagaagaagagtattcttgtgtgtggtgaaacagatacccctgtcgacttaggaaaatagttttgaaatataagtttttat

SEQ ID NO: 394326 - DNA, 462 bp, Homo sapiens
ttatgagaaataataagtatttttctatttacatgagaatttaatctcaaaacaggaatcagaaatatattaagtccagggcataaaacctaaaccactgctcatatttattctttctaaatagagcaaagtgtaaaatcttctccataaaatgcacattgtgcttatgaaaaggccaaagtcttagtgagaatcattggtattccatagaagagtgaattaaacacagccaagggaagacccaagtctcatacttctcttgtatattccagagttccaggggaattccaggtgatagaggtgatctcccatactgttaaagcaaggttgcagacacttgggaattttggtcccagtactctaggaggtcacacctctgtcctggacaatactacaggaatgtatactcttcctatgactcattctggtcattcttccagcatcacaaaaaccaaaaaaaaa

SEQ ID NO: 394327 - DNA, 316 bp, Homo sapiens
agtctttatttcaaaataaaatactttttaaaattttaacaaactatgtttaggacagtgatactaagaagctcttctcaaaatcaagaatattgtgtaagaagagtgtcaagaaacacctgaattctaaacaaaattcacctaccaacaaattacatgatcttgaactagtcactaatcattcttagccatggtttacttatctgcaacctgggagtaatcatgctcctttaacctagctgagatggaagactatatacaataaaataatggacagtaagcaaaaagaaaaaaaggaaaaaaaaaaaaccacaca

SEQ ID NO: 394328 - DNA, 208 bp, Homo sapiens
tggaaatgttctaaatacgtgctgtccaacacagtagcacacatggctaatggctatcattttggacagtgtaggtctagagaatagcagtttggtcacgaaaaattaaagagctttttcataaaacattagggttttttgtcgttgtctgtttttgagacagggtctcactctgtcacccaggctggagtgcagaggtgcgatctca

SEQ ID NO: 394329 - DNA, 337 bp, Homo sapiens
tggtttaaggaagatggcatagaaaaaggcatgtgtcacagcatgggccaagtgttgggttccttgctataagtcaggcactgtgcttggtgctctacatacataatcgctttaacattcacagagatactgtgaagctggcattgtgatgctcattttgaagatgaagaaatggagacgcaacatcagtgagcgtctccaaacttacaccaatagtgagcaacagttttgagattaggacccagagatatccaagctctccatagtttgtctccctgaaatgcagagttgaaatattgtcacctgacatcctcagagtcagagctgaggactttaa

SEQ ID NO: 394330 - DNA, 342 bp, Homo sapiens
atctccatcttacaaagcttaaaaacaattgccagaactaggccgttcaaccccacatttcctgggcctcccctaagcactcagtcctctgtgtttctgccctgcgccccacgccctcagcgcagcacctcggagcccacagtcccaagctgtccacactctggcgcccctgggcccattcacattcccaggcaccatgcgctggtcagccctctcggccaccacctttgctagagcctatcaagaccctccggagcctctatttaatgaaccactcagtcattccagcaaagcggttactgcctttcctctacctggaggcttgttctgtgtagatgtttg

SEQ ID NO: 394331 - DNA, 575 bp, Homo sapiens
gagctttttctatttcttccccgggcatttctcctcctcgtgtgatgacagacaaagctaccaagccagaaaagtgtcatgtgcttgtgaatttacgagcagcacagatacatttaccttaaaggaaaacaaagctatatgatttgaagtataaagcgttgagctcaacgctttatacttccctactccttgaattttggcttgagcagccagataggtagtgggtgtcatttctactgaaattgaggagtagggaagagaagcagatttggagcgggggtggggggagatagttcacttttggggttgtcaaggttgatggtaatggggaaatccagagtttggactggataaagccattgggagtcagtatctgggtggccagtgaagcccctgaaagactgtgacatgagaagagggggtcaggactagaacctgagaaatgcccttatgttagtagtaggcagagaaagatgttaccaaaaaaaggagacagagtaaccaaaaaggcaggaaaacctttgtgtcatgggaactttgggaagagagtattgttagaagtataaagcgttgag

SEQ ID NO: 394332 - DNA, 506 bp, Homo sapiens
ccagtgtttatgacatgattccctttagatgaagtccaagaatgcgacaaagttatcaatggtggaaaatatcagaatggggattacctttgaggcatactcgttgcccgggaccacagcaacttcactggtgctggatcattctgtctcctgcactagttgcttatgcagttttccacctatatagaaattcatggagatgcttcctgtctcagtgtgacctcatttgtctgagcatcatcactgtgtcattgcaatgtccacatgcatgctccccaataacccttacccctcagtgaaccagtgtatctgtcagtgtgattaacctgtatcctctccagtgtgcaaggcaggagaagagaaaagtgtctccaaactagcaactgcagaagaggagccttccagtttagctacacagcagaacttccttctttaggagactgccgatgaaacgcctgccctcccaactgtccgatgtcgctgtgacagagctcgctatggacgtg

SEQ ID NO: 394333 - DNA, 338 bp, Homo sapiens
tggattaagaaactgagcataactcaaagactgagcaatgtgctcccaatacaggcagaacactcatattctagaagagaggagagcacagattaggatatccaaacccactgactggaatcaggagcctagcatttccttggtaactatcaactggccagtataattttaacatggaattcatcacttaatacaaaacagaagtgtcaacaggactgtccaaaaaccaaaattaactttcttctaagtcatgcagagaaggtactcatgtccacaatgcagtgtccttctcaaaaaacttgttgcagaattggacttctccattatcaatttctcct

SEQ ID NO: 394334 - DNA, 561 bp, Homo sapiens
aggcacatggacaagaggctgtgtggccacaggacgtcacttacaaaagcaggcagaggagcaggcttgtcccgagggcagtagcttgctgactcctctctagtgttatacaagatctggtacacaccataacccacgtgacatgtctaccgtgggatatctaaacatttttggtgatctaagagggatggagatagagactcccatcccaggtgaccatctacgggtctagataagccgcatcactgtcaaagttgtcgtttccatttagcagcaggtcatcagaggccaaccactaggacccactaggatcttgcaagatagaattgtgaacgggaaatatccctgagagtgcttttccccagcagaagccatgattggctgcatgggacctctcaccttcccagggccaacagctgctgctttagtctgtggccccttcctggctgcagaaccaatcatcatttatagctccttcaaatgactgcatgtttggaatgagttcaggtaaatataattttaaaaaataccatgggcacagcacacggtaagccctcacac

SEQ ID NO: 394335 - DNA, 259 bp, Homo sapiens
cctgccctgccccgcctcctcagaggccccatttcctttaatctaattcttatggggaaagaaacgccacgtgtattaaagtgcaggcttatctatttcatcacagatctaagccacggtgataaatccctaagctaaacacacacaaagggaaatacgaagcttgaatacagagcagaataaagaagcagggcagggataaatgtggccttcgcccagctgctagctggcggcccacccacagcggggtcttgatctg

SEQ ID NO: 394336 - DNA, 379 bp, Homo sapiens
actaactttatattatagaccgtgattcaacttcagttctgccctgacctgtggctctgctccagactttttctcatttgggaaccaaggctgaaggaacaggcctcgtaagatatgtgccagtctcttcacaaagtactacagcaagaaggctggctgtaactcagattgctgcttaaagcttttggtaacatgcattgtacctcacttctattcacattctattggccaaacatatcacatggctgatccccaaagcaataacctagggatgtcaactcctaacacacacacacacacacacacacacacacacacacacacacacacacattctctctctctctccctctccctctctcccttcctctctccctct

SEQ ID NO: 394337 - DNA, 499 bp, Homo sapiens
cgcagagctgttctagaggatccctcataggttcgcaggggggagcctctgctgtgtggtttaagtggaggtctctgggattttcaccctgacttttcaatgaggataccttggggagcaagagagaggaagccagctcctgtaaccgctggactgaacagctgggcctctaactgagacattattagcatttgaaagcccctctgaagggaccaagagcttcccagggtgggcgcaggggcctgagtgctgagaccccacagtggctccaacagaatgggtctgagcatccagggcataaagaccagaccggactcaagaatgaactcattgtggctttgtcccatgcttgaaaactgtgaccagggctctttcattgttaagaaagaccatttcttgtccacagaagagctcataagtctagttccttcatcaggcagagctgcggaagaccctgcccctcactagaagtttctgttagtgtcctgcgaacctatga

SEQ ID NO: 394338 - DNA, 428 bp, Homo sapiens
tagctgggactacaggcacccaccaacacgcccggctaattttttgtatttttagtcgagatggggtttcaccgtgttagccaggatggtctctatctcctgacctcgtgatccgcccgtctcggcctcccaaagtgctgggattacaggcgtgagccacagcgcccagcaccaccagctaatttttaaatttgctgcagagaggaggtcttgctatgttgcccagactgatctcaaactcctgggcttaagggatcttcctgcctgggccccccaaaactttgggattacaggagtgagccactgtgcccagtccaggactcggttctaactggtttcttcctgccttatggctgctccttctcacctctctccccgcctcagtctccccaaatcctctcaggcttgcacgctcaaatgtctgtcct

SEQ ID NO: 394339 - DNA, 126 bp, Homo sapiens
aagttccaccaatatctgggtacagtcataagcaaacattcctcaaacatgcctaaaacataattcacgtgtaggaaaaagaattaacagtggatctgtcacttgttctttccctccttgggatgt

SEQ ID NO: 394340 - DNA, 343 bp, Homo sapiens
cttgactgtcctgtactcaagctatgtccccggggtgatgacagggaggaagcgcaactggagacaatgagggggtggtgggagagtttctagagtctgggcccaagacattcaccactgcccatctgaatcccttcaaactcccattcaatctccaccttctccagcccacagtgacctgtcccacctgctaacagcctgtgtcactgagccaggcttttgctcagtgggtatgtctgaggactaaagcggtcaaaagagacttcctccttcccaagatcccacaacagcaccacgaacagggaccacctaagagactggactacgataaggacgggcatga

SEQ ID NO: 394341 - DNA, 586 bp, Homo sapiens
gtgactctagagatcccccttcgaggtgttcagagatcggatggtgggaggacacctgactccacagcaacctgctgtcaggagccacgttgttcctgagcccaagctctccaaggctgtaccctggggacccggctgtgggaagtgtctgtcctgttaagggaatcctggcctctggagccccagtggaagctgggtgcggtacacagccccactgagcttgggactgcagatgctgcctttcccagcctccctgcagcaagggcgtcctcccagagttgggggtggggagcagagcctgcaggcagccactggaacggtgcacttggtggcatccagggacaggatggcaggtgcagctgtgcagacaagcgtggagtctgcttcccagccagcacggagggtgcagcccaggctctgcccctcgtctgagccctgttcacaaactcttcctgtgagtcagctactgtggcttcttcatgctctgtccagaggcaatggctttgctcccacttccaccagggcccaggaaggacctgagaatgctcacccatgccacacagagcaccggccaccctgctcaccc

SEQ ID NO: 394342 - DNA, 376 bp, Homo sapiens
tcaggtgctaaacacaagctattactagaacccaggtgctctgacccctggcctgtggttttggcccaaaacagtgtcgcctccagtggcaagtctgcagtgggcagggtctggatgtaggcatgttctgttgtgccctagcagctggaaaggggcggaggcagggcagccttccaagagagcagacacacaagccctgtctggacctggcacagcccggccccttccggagaggaagggttcattctcttctgtttcattttacatagcagccccaaattttccactcaatgagagcccagctccaggaaggaaatgactctggccgagatgccaaacccaaagttagaaactgtcaagagttgcacaaccaaga

SEQ ID NO: 394343 - DNA, 357 bp, Homo sapiens
agaaataagaaaatttataaaatagtttgaaatcaaaggaaacaaaacacaacaaaagaaaatatatatgtagctaaaagagttctttgggaaatttatagctgtaaatgtccatattaaaaaaaggaaaatctcaaatcaataatctaaacttttaccttaagaaaacagaaaaacaaagcaaagctaaatcaagtagaataaaagatataagaataaaatgccaataaataaaataaaaaatacagaagaaaaataaaaatatcaaaagctggttcactgaaattttttgtttgtttagtgacaggccaggtgtggtggtgtgttcccacactcccacctactcaagatgcagag

SEQ ID NO: 394344 - DNA, 363 bp, Homo sapiens
tcacatctgcttagatgctcacctcaccgaaagaccagttagatattcattcatgcttaggtgtaatatccagagagaacttcaaactctcccttcttctctgatacaaaacactttgtgaggaatacagagaatgaaaaaataatggaagaaaagcaagaatctagatgtatgtctccacaaaaaagctcatgagaagaagcataaggagaactagaaaggaagggctcatataaaaccaaactgaattttgggagactgggcagaagaatcaattgagccaggagctatgactgcatcactgcactccagcctggacaacagagcaagaccttgtctccaaataaaataaaaagtaaaacc

SEQ ID NO: 394345 - DNA, 284 bp, Homo sapiens
gagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttt

SEQ ID NO: 394346 - DNA, 244 bp, Homo sapiens
atagaaagtacatcactagtctctaaaaccaaacgtggttttgattgaaccagacttacatttatttctgaagctcgtttgctaacaatagaactggctttcccatttgccaagatcaatgttgacctgttttcacctaaattttatagatgtcagaaaaagaaactgttcactattcagtggcataccctggcctttctcagccacacttgcttgcatttttgcagctcctttaaattcccct

SEQ ID NO: 394347 - DNA, 380 bp, Homo sapiens
gcttagctcatgagccctaggagcctgatttactcagtgctttatgttttagacgttatattttgctgttaaaggaccttttgaaaactttcctccttttgggattgtcccactatctgatttttcagcctccatttctcccagtcatttctgtcctgctcagttttgtttgtttccgagtatgtttgtatttttcagttttctcagcatgtatatctcagttctggaaagtcataggaggttggagagggatttcctatttcactgatttccaagttccagacttcccagcattctgtgacttctcccaggtgtgcacactaattttcttgcactcactttcatcttggaggcagtgaagattttgcccagggtcccct

SEQ ID NO: 394348 - DNA, 459 bp, Homo sapiens
acactgaacttcattttgaaagtacagcacagctctcataatgtcagttttcaaaatttactcacatgaagcaattagattttacagttcaggctctatatgtctttatataagcccgaatattactgtttatgttaagcaatgcatggaatctattctctgattttccccctaatatttcagtttccaattataagacaataagatggataattctgtatttagttgactcatactaataaaaatctaaaaggaattaaaaaaaataatacatgagcacaaatcagtaaaggctttattactagaggaaaagtcagtggatcgctcctaccctcttacttgaagaccttacgtgtcgcatggggatgctgtaatctttggaaagatgctcttatttaaacctctggagctctctctgttttctcaaccatccattattagctatctagaactaattac

SEQ ID NO: 394349 - DNA, 234 bp, Homo sapiens
cgccttggcctcccaaagtgctgggattacagacgtgagcctccgcgcccggctgctttgacatttttcaagactacagccagttattttgtagatcgtctcacgctttgaatttgatgttgcctcatgactagttgaggttatgtaattttcaggcgaaataacacagaggtgatgttgtatccttctcagtgcatcgtgttaggagatacgtgatgtgggtttgtgtcctta

SEQ ID NO: 394350 - DNA, 492 bp, Homo sapiens
ctatggccctggtgaacccttcctctatggtctagactgagcctagaaagccagcccaaaccctagtcattcttcaaaatatctgggccaactttgattaagttagacattacttaacgttaagctccagtttttttcacctgtaagatcgggttgttgagtgattacctgagaaaatgcttttatccataaggcattgagactttgttaactttcagcaaatttgagctgtggttactctggtttcctcaactgctccccatcctgagttcccttgcctgtgctgcctatggcaccacttcacacagggtattaaaatcagagggatgggctggtctctttcattagattatatattctctaaccacaggaactgtgtcttcatcatggtcacacaagatagtggcggacaatgtgggccttggacccagactgcctgggaccttcctggctccatcacttactaattctgcgaccttgggcaaattactt

SEQ ID NO: 394351 - DNA, 660 bp, Homo sapiens
ccaggaatcaagacacctggattgtgtggaaggatcttgagctagtcacttgccctgtctgggcctaattttctcctctgtgaaaatgagcggtttgaactagatgctctctaaagtcctttttggctcaaacgttctggattttctgaccacatgaactgggtctgatccagggtacctggcatttcctgcaggaagggcctggaggttgaggaggaaagacagcagccatgctggtctaggaaaggagagaagcgccccacattcatgcatgaggaactctggaagacacgggcattgctaatggtaaagaaatccattgcctggacctggacccaatgtcactgtggcttctaaacctgtggccaaacaaggccactctattattaatctttcttgctgttaatgttctaaagcaagtataatagtacctgcctcaccttagatcactaggttatttgaaaatagaataaactcatggatgtgaaaatgctttgaaaacttctacacagagactggaaattattttcttagacatctgtcaaggtcacgacagatgattccctcaggattcagtagggtcattgggggatctgggagcaggtttttgaaagctgggattaaggatgtggccaggtaattccccattgatcctgccac

SEQ ID NO: 394352 - DNA, 500 bp, Homo sapiens
agttacaacagctcagtatgagcacatttgcctagcagaggtcagtaaactctaactccctccaaaccccatccctcttgcctttcagtcttgcatccagcaagtagttaattcaggcattgtcatctgcaacttccttttgacctcctctcttgagtctaaatatcctttggttttagaactagacttgtttctcatttaatttcctttacatctctctaaactccgtttcttctttcctcagtattcaacacattttttattctccaaagccttgagacattttgggaacaaccagtggaggagaggaaagtagagcaccgagttttaaggggatggcgtagatgtcagggacctgagttgttgggggagtagccacacgttagggacgcaaccttgaaatacacaaaataattcaatagtttttttgtctctgttatgtcgggacagatttttccaagttacttgagacttaatactgattcagggatcttcattaa

SEQ ID NO: 394353 - DNA, 188 bp, Homo sapiens
cggccaaaagattgacttcttatctttatggagctcacactctgtttggggagaaaaataaccagatgaaactttcagaatgataactgaggtaaaaggcactgtggggaagaaaggaagggttcaggctggggaaaggctggagatagaaaggcatccttagatgacccctggagcgttgagggtag

SEQ ID NO: 394354 - DNA, 258 bp, Homo sapiens
atgacgttcacctggaaactctacagatgggaccttgactagctaagtctaggctgactggagagttcctatctgtctattacctatctatcatctatcaatcaatttatctatctactatctatctatgtatctatatatctaacatctatcatctttctatcaatcatctatcatctatatatcaatcatctatcatttatctatatattcatctatcatctacctatcatcaatctatcatctatgtatctaaca

SEQ ID NO: 394355 - DNA, 447 bp, Homo sapiens
cataattacagagtcttatgtgtggaaatgctttgcaacatgatacacggggcttggatgcattcgataagtgtgatctctatgagtgaaaaatacatatattatatacatgatctctacaagtgaaaaattcagatcagcttagtgaacaccaattattgtgctattatacaaaggagtatgagttgataggaaattcaaatacacatacagatatgtattacatacatacatatatcatatacaacatataataaaatgtacatacatatttttattccatcaaactaaaaaattagagttgaaagtaatatatacttatcatagaaaattaggaaaatacagaagtgtgtaaaaatgaaattctgaaaatctttcccaaatgagcaattttctcattttttaactacagaaaaagtagtaccgggattttttaaaacctgaaaa

SEQ ID NO: 394356 - DNA, 310 bp, Homo sapiens
ggatccaccttcatgttctttgattcacaaaagaccaggaaccttccgtatttggggagggaggaagtaagagagagaggagtccaacttatttatgttggacagtaaccagccaaagtttttatacagagagagagatgaggtctcactatgttgcccaggctgatcccgaactcctgagctcaagtgatcctcctgcctcagcctcccaaagtgctgagattatagatgtgagccaccacgcctggccccagacagagttttgaaatacagatgagtgtcacagccagtcatctggggggacctactg

SEQ ID NO: 394357 - DNA, 382 bp, Homo sapiens
taaaagccaccatgtaacccaaagatatgacatttgttttttaatatccgtctgagagaaaggattgggaagcctataatgggagattcttagtgataagagaaacctggcagtgcccagacggtcaaataatttaagggtccccgatatatatgatcagccccaaaacccagacatagtgaatgtcaaaagacacctgcagaatagaacttgaaattccctacggatcacaaatttgtcccaaggttcattttacatttggggagaggaaagaaggagataaggaaaaggaaaaaaaattcatacaaaaggagaaagaagaaagtcaaacaccttgacacaaggtgcttagtcctccaaggtagaagtttataaattatca

SEQ ID NO: 394358 - DNA, 2578 bp, Homo sapiens
  misc_feature (2002)..(2002): n is a, c, g, or t
cattgcaaatgtccttaatgccactgaactgtacacttaaaaatggctaagttgggctgggcgtgagccaccacacccagccagatctgcctcttagaacaatgctatggaagttgattttggggaatgggtggaagaggcagaggtcaggcagagtgttcaataaagaggatcagacaggccaggtaggagaagctgatgcctagcctaggacagggcaggtagctcagcaagtgtgagcacctctcagtgtaagagctgaggtgggagaggggcagatgggctgtggagctggccacactaaaggcagctgtgtgtttgcagggctcaggaccaaagggaggctgagtcaggaaggcactcctgggcttctggcttgagcaggctcaaagtcaacagatgcagctgcatctgtgtctagcgattgggaaggtccacagcaggactccagctcatacctgggagtcagggcaaagtccagcctagggaagagcccccaagagccaggctgggtgtcaggtggggcccttgtcctgaagggagaagagactacaaggtagagcaccaagcacacctggctctggcacctttacgtctctggccacttctctcttatggctccctgtaacaatgagatacggacacctggaggcacctggggctagtttcttcctcatacctgccccgctccgatgaggctccctccaggctccgcatcttgacttagttacaacctgatcctgagctgggacccaagggtgtcctgctcctggctccaatctcctggtgaggatgaactttggtttggctccacctgctcaagtgccttcggaagtgtgcccaccttgccagcctcgtcagaatgcagtctcaggatgatgaaagagttcaggaaatgccaccccaaggtacgtcactttggacttcaaactgagagcatttgaggaacagcaaatgcagggagggactttctctgaacttcccttatctgcttcaagataaatcctccaaaaggaactcaatggttataactcccctccccaggaacctcatcaaccagagaagagtaaactcagatcacaggacaggagactgggggtcaacaccacccccagacagactttatcacatatcacctattcttctgaaggcccattcatctttcctccaaatcatttactctctcctaagttgcctgaaccctccctccgctcaccccctttaagaggtatatatgctctcactgaggtttaggacatttgcttttctttcatgtgatgcccccatgcatgtagtatatttgtgtaccttttcttctgtaactctttcttctactgtcagtttatttcatagagtcaattaccgaaccctcagagggtagaggggaaatcttccctcccctgcagtgatgctctgggactgccagacacctggtgtctaatagacaccagaactcactcccaacagcccatttgggcaattagtcgctcatatgataaacatttttttaaacccccaaagtgtaccagtccttggactgaaagctggatttacaaggtcaaatcagattcagtccttgtgatagaagagttcataatacagtggagccaaacgcatgaaacataacacagcctattacaacacaacgcgacatgacagcttcacacatcccaacacaggatacaagggctcaggtctggtttctaacttctggggcctcagctgagaaaagggcagctcccagtgaaaggaggcttattaattagggagggagcttattggaatgtcagcagtggaatgcagaggggaagagactctaagtcagactagctgcttcagtcctggcaccataatcttggatggatgacagaactctctgtgccttagtttccacatctacaaaatggagagaataatagtgtgtatgtcatagggcttaaggattaattgagataatacacgcaaagtgcctggcacagtgcctagaaggtatagcaagcanaatagcattagctgtgtggttcttgttgccatagaattatagaacctgattatactcttaggttcttggagtcagagaactgtagaatcatagaaccctaggaccttagaaccttagacatagaggtttataaatatatataaatataacgtgcaccagaatattagctaggagggtgaagaagggagatctccccattccttcagattgaggcgaaatgtcctctaatgcctgagttccagggctgtcacattcagttgctcaggttgtacctaatatacctctaaagaaggccattcacatagacttcgatgtgaatggagttccttagacgcagcatgacatgcaccattgcgtgagaaagcccacatttctcccagagaagtcggctaagtcccagggggcttacacttagtaccataatctctgcctccagcaaaacatgctggctttgtcctgagccacactgacctgaatgtgatgaaactgaaacttggattccatataaaaataaaatcactcctgcacgttgtgcacatgtaccctaaaatttaaagtataataataataaagtta

SEQ ID NO: 394359 - DNA, 538 bp, Homo sapiens
ggaggtcgaggaggcggatcatgaggtcaagcaatcgagatcatcttggccaatatggtgaaacctcatctctattaaaaatacaaaaattagctgagtgtggtagcacgtgcctgcagtcccagccactttgggaggccaaggcaggtggaccacgtgaagtcaggagttcaagacaagcatggccaacatggcgaaaccctgtatctactaaaaatacaaaaattagccgggcatggtggtgggtgcgtgtaatcccagctagttgggaggctgaggcaggagaatcacttgaacctgggaggcagaggttgcagtgagccgagatttccactgcattccagcctgggcgatagagtaactctgtctcaaaaaaacccactagatcatctctagaacattgctactcccaagtatgatttgaggaacagcagcctcagtatcaccagggaacttattagaaatagtctcagcctcaccactattcccacttaattgtaatctgatattaacaagatttcccaatgtgggtcaggtg

SEQ ID NO: 394360 - DNA, 343 bp, Homo sapiens
ttacaggcgcccgccaccacgcccagctaatttttgtatttttagtaaagatggggttttaccatttcgtccaggctggtcttgaactcctgacctcaggttatctgccaacctcggcctcctaaaatgctgggattacagttgtgagccaccacgccatgccatgcacaaggaatttcaagacatccccatttactgtgtccccttatgtgtctgtgcctttgccgatttcttccacattcaatctctatcctcctttctctatctgctgaatgattttttcttcaagaactaattgaaatgtcacttcctccaccctcagataattagttccttcctcctc

SEQ ID NO: 394361 - DNA, 482 bp, Homo sapiens
tttggtagagacagggttttgccatgttggccaggctggtcttgaactcctgatctccggtgatccacctactcagcctcccaaagtgctgagattacagacatgagccactgcgccccacctgaagtacattttctaaaaatggtaactgttcaacagttgtttaaaggtgattgtttaaacttaatcattgttcaaagtgtggaggaaaagatgtctagcaatatgaaagcaagaataagaggccaaagagaaaggccaagatgggtcacctttctctatgccaactcccctggtcacccaaagcataggccccaatcccaagtcagaatttgactatatctgtgccctgcaatagaaaataacttcatgtgttttaatctgggtacctgtgaatgtttttgtatgagtcaggatagcataggttatgctgcataacaaacaattctcaaaaaactctatttggccataacaggtcagtg

SEQ ID NO: 394362 - DNA, 426 bp, Homo sapiens
cagaagggaagagtggaaactggcagaagatagctgtgtctgccacagatgggtcttcagaaactatcaagttgagtagaagtcaccagccactgacaagcccatgagtctccatgagtcacaagtatttctttggagcagggttgtctcactgtagtgtcagatgaaccctactcaccgggacataccctcatgctttgaggaacccttttcacttcagggatgttgttcaggatagatctgccacatactaattgctgtctcaaaactgaaaattgttataataatggtttcatgtcttcgctagtatcatatttctagtcaagcactggttttttattattatttacagaaatgactttgctagaaggataaccacacacattaaaattttgcctaagtgtagaacaaatgctattgtacatc

SEQ ID NO: 394363 - DNA, 393 bp, Homo sapiens
agagcctcttccagcatctgccgcccttcagtggcctctgacttagagcagtgagtacgcccgggcaccatatgtgagccaaaaaaaaattccaagcccctagttgactgaatggagccccctcttggccaacggtactcaaggaaatctgaaaaacaagttcagcccatgacaggaaggtgggggccagacaggcctcgtgagaccctcctccttttggagttcaggaacgactgaccagcgttaacattaaaatcgagctcttaagcctgacaaaacaggccaggcgcagtggctcacgcctgttatcccagcactttcggaggctgaggccagaggctctcctgagctcaggagttcaagaccagcctggggaacataatgagacctcat

SEQ ID NO: 394364 - DNA, 257 bp, Homo sapiens
aatgtctgaggttggtgcgctggttcccagtgacctttcctcaccattagctcccaggcaagaaagcagtgagcatgaaatggtcacaaagtttaatgatcagctaaggatgtaagcatgagcctgaaggctccaaacaggaggccatgtcagggaggcgtggcgggccaggaagctaagtcctcacctgcgataacaggaaaccaacgtccaaacacaccagccagggaaaggcagggcacggtgtcctgcagggg

SEQ ID NO: 394365 - DNA, 409 bp, Homo sapiens
accctgttccaccccatcctgaaacactttctcctgcctcttaacaattacagcagtttctaacagaccaattcatgtagttttgttcactttctactgaagtaggaatatgatttctaatgcgtattttcttcttacttttaaaaacattttgtgtgtttaagcttattgctcagttaggttataaattcctttaggggaagaagaaatatttcatctctttcctactctcaccagatacttagtccaattctcactcatactattagggtatcttgattttaaaattacatcagattaatgatgcaattccgatccagacaatcagacttcatgactaccaattcagacacacaactaccagcatacacctgattaatctgattccgatccagaacccaaaggggga

SEQ ID NO: 394366 - DNA, 157 bp, Homo sapiens
tgtagatgtgtgtgtggtgtgtgtaggggtgtgtgtaggtgcatgagtgtgtaggtgtggtgtgtgtgtaggggtgtctgtgtaggtgtatgagtgtaggtgtgtgtggaggtgtgtgtggtgggtgtagatgtgtgtgtggtgtgtgtgtaggtct

SEQ ID NO: 394367 - DNA, 788 bp, Homo sapiens
acaatctgtttttatttcggggcacagcaaatgttgagaaccactgtcgcaggcgggcaaaagcggcactccccatgtggttggggatgcggggaatgaactgaagacattgttagtcacctgcctccatttaggcctcacctttatgtcatcagcccctctgagactcagaaatgatgtctctctctgacatgggtaagtacaacagtgagagagaagacatccctctgagtttgtctgtccttgagcttgctctgcgccctggggaaggaaggcctccctcctatggggccatgaagctactgcttatcacacactggatcaggggaaggaacatgggctgggcttcaggagactcgagctctactttttaaaaaccagcgacttacagaccctgggcgagttcgtcgccctctctgggcttgttccccacatgtaaaaggtaggtcatgatggccgtgacgtgccatactttccgtctcctgtctgctctggaggacttgtgctgtggaagctgtttctccatccccccagatggatcccttcttcctagtttgcacaaaggtgccgaatggactagcaggcagccttgctagaggggctgatggcttgtcctaagaagatggaataaatagaagagtccttaacaagcctcgttctcctgaccacgaggatagaaaggctcagttggcacactccaggagccaccagatgactggcaggatctgtttgatgactaagtccttcctttggcaaaactccacgtgacgctgatagggagtgagaac

SEQ ID NO: 394368 - DNA, 147 bp, Homo sapiens
aattatttgtgttttattcttctcactacattaggtcaaagccttccttagaacttcaatctcacacacagatttgagccagtaacccctgtcgctctccctcctgagagcaggtgttttctcttcccggcgcccagcagagtatgc

SEQ ID NO: 394369 - DNA, 432 bp, Homo sapiens
tgtacatatgagggtatgaggtaagagagtcgagcaaaggatcgttcagtgaaggggacctaagacaggaacatgcctgattttatcaaggaacaaaaaggaggccagtgtgaccagagcagagcaggatgagagtagcgtaagaagaagttgtggatcactttaaggacttaggctcttgttgtgagtgatatagggaaccattgggggatttttgaacataggagtgctatgatccaacttaagttttttaaaaaatgattctggctgctgtgttcagagtagcctatagagagcaagcatagaaacaggaaaaccagtgtaataggaggctattacactaattaaagaaggagatgggtggcttggacctggttacagcaatggaaataatgagaagtacttagattctggatacgctttgaataactg

SEQ ID NO: 394370 - DNA, 400 bp, Homo sapiens
ttatgtgtggctcaagacaattcttcttccaatgtggcccggataacaaaagactgggcaccccctgattaaagtatacaggaggatgtgcatagattatatgcaagtactacacaattttatataaggaacctgagaatccgcagagtttgatatggtggcggggaagggaagtcctggaaccaatcccctgctgataacaagggatgactatatctaattttgtttatccattcatctgatgttggacatttgagttgttctcactttttggctattgtgaatggtgctgtgttgagtattggtatataaatatctgttcaggttcctgctttttcagttcctttgagtgtatacctaggaaaaaaattactgtatcatatggcaattctatgttcag

SEQ ID NO: 394371 - DNA, 420 bp, Homo sapiens
tttcctgagccctgagtcacttcattatggtcccatggagtctggtcatttccccacaatctgagcacctcatagctggtttacttctaaacggcagcagtcaccgtttacacagcatttttgttttaagcatggttgtacacaatgattaggtcatcacggcaacccaagggcagccagggctccagctatggaaggctggcttagtggatgttaacagactcaaatcctatacttgctgaccacatcgagtagccccctaatctgaaatcattggaacttttgaaatacaacagagcacagcagtaacacaaggaacaggccccaatgccaagcacaacgggaagacttctgctgtccttacaaactgctcaaggaaagctgacctgcagaggtgagcacagagccaccccgcacacg

SEQ ID NO: 394372 - DNA, 442 bp, Homo sapiens
actctgtgctatagaccaactggacctaatagatatttacagaacatttcatccaacagctgcagaatacacattcttctgctcaacacatggtttattctaaaggacagaccatatcttaggccgcaaaacaagtctcaaaacattcaaaaaaactgaaataatatcagatatcttctctgaccacaatggaataaaactagaaatcagtaagaagagaaattttggaaactatccaaacacatgcaaattaaacagtatgcctctgaatgaccagtgggtcaaggaagagattaagaaggaaattgaaaatatttttgaaacaaatgataatggaaacacaacataccaaaacctgtgggatttaaaaaaaaaaccaaaactgtgggatacagcgaaagcggtactaaaagagaagtttatagctgttaagtgcctgcat

SEQ ID NO: 394373 - DNA, 237 bp, Homo sapiens
gcactcctgccagcccagtgtagcctcaggcctgttgggtctacccaggagcatggcagaattatatagcacttggtacttaggaaatgtttttatggtcagttttaaacttataaaatcaagattgaaatataacagacaagaaaacataggtacagaggtaatttggcagaggtcctacatcaagctagctaaggtgtcaagtgaacctgttctcccatgtgttgttattgatct

SEQ ID NO: 394374 - DNA, 322 bp, Homo sapiens
gggaagaccctagtcggaggcccccacccttgcccggaactggactttggggcagcagcaaactgcagtgagtgtgagtcacacctgaggacaggtgggctgtcttcaggctcccaacaggtctgtcgcttaaggggctggggaatgggggctggaatgccacggcctgcccacctgggggactctgggcagagctggagcagccaggcaggaaaatatcccccagtttccagagagtaaaagctgatggtcctgctgaggtgtgaaggacagtgacggacagtgatggaaggtgatggacagaggaggacagtgatggaca

SEQ ID NO: 394375 - DNA, 395 bp, Homo sapiens
ttttgtttaagtccttggttttattcttctttataattttcagccaactccctggttcaataatcttgccaggaagtttgtaatgatcccttaaagtgacaacttccataaatctttaaagatgaatatttaatgaactcccaatagccatccatacggtaacatccagttgttgccagtcaaaatgcaaactggctgttttcaggaacagcatagagcaataaaatacgtgtttgcttgtactgtctgttctgttgaaccgttgtcttggccttcacaagcactatttgggacccagcatcttgctttaatttggctttgaaattctaatgcagaaatgtgatcacattcttcaacttgtcctgtgctgttgatcacacagcttcttgtcttgc

SEQ ID NO: 394376 - DNA, 526 bp, Homo sapiens
gggtcctggcaacacaggttatgggaggagggagaagagaaattcgattgagggaaatacacgattattagggaggattcagtgggcttgaggggcattcagtggtctaggacaaggtctgtctgttgcccataaagtggacagtggtttgtgacaaaagtctgtccaggtttgtcgacaaactctaatcctccttcctgtgatatgcgttcagttcatgaaagcccagggagggaactagaggtcactggtttctctggttagtctggtctttaggcaaataaggcaacttcagcccctgctttgggagaggtggaggactgagaggcaggagggggaggggaggaaaaacacttgttctcctttgcgggtctctctgggtctttatgtagatgggggaagtctcttctggcatgtgttgatctctaagagcctttaattcaacatactcattatagtaggaagccatattttgggatgaagttctctgtgctccttcaatatgtgtttttttttttaaatgcat

SEQ ID NO: 394377 - DNA, 327 bp, Homo sapiens
ccccatattaaacgaacaagacagacctaaactattgactaattctccaaagcgaaaagtcaggaaaataaaaaaatctcgttaagctgtaacaagaagggaatcgtgaaatacgtaaattgggctctttcatattgtgaaatatatatttggtgtttgaccctctctcccagtacataattcctaaaattcctggaatctccaaaatgatgtctttttgtatgcttaggcactgactgatggctggcagcccctgggctgcttcaatggggctggtcaccagaaagaccaaggcagggttagagggttgggactttcagcccctcc

SEQ ID NO: 394378 - DNA, 579 bp, Homo sapiens
tggcttttccacagggcatgactacaaggcctttgggcaagtttttctttgagtcacttgaactctgatgcagtgaagcaccaacctcatctctgggcaatacctacattaggctgttcttcctgccaattagtttctaaaacaaaaactagacatacagacctcttaatctttcattgttactgcttccattttaggacactttaagtgcaaacccagatgcctaaaataaggacaaatgcagtcacaacatttacaattcctttaaagaacattgtttttaatgaatcatttgttcaaagcagaagtgaatcaatagtgtgctttggtctctttcatgctaaacctttgttgatggtacactgaattttgtttcttcactgaactcagagaccctgtgacatgctggggagatccagggatttagggaggtgaagaataaaaggatgggaggtaattcatcactgtccttccactaatcactcccaggttttacataaaagatgcctagttttctttgttcaaaccatatagtaacttaacagaaaaaattgtcctcgtggatgcaatctcaaattc

SEQ ID NO: 394379 - DNA, 375 bp, Homo sapiens
aaaaaaattctttttttgtagagacgggaatctcactgtgttgctcaggctggtcttgaactcctggccttaagtgatcctcctgcctcggcctcccaagtcgctgggattgcaagtgtaagccactaccccggcctaaaattcaattttaagcgtataatttgataaattgtgacaaacatatgcagctctgtgacaactaccacaatcgtgatatagaacatttccattacgactaaaagttgcagtgggcctcttggcagtgacttccttcacctgcctctttactccatggtaataatgatctgctttttatcactatagtctggcttttctagaaattcatatacatggaactttatagtcttttttgtc

SEQ ID NO: 394380 - DNA, 585 bp, Homo sapiens
ctgtttaaagtctatgtttcatttctgagtgcttgtaaaatttacagatccctgagttccatcccaaaattaccaaatcagaatctctggcgaatgggtccctgggaatccatagagcaactagacactcaggtgatttaaccacagaagtttgagaaacattagcaggtcttaaagcaaaagcttaacaggtaggccagcaaattttgaaaaacgagaataatttatttttagctataactgaatacacatcctataacataccatgtttgtcaggcaaaacactgaatatagtgagtttcacaatactatgtaatgtgaggtataattgctaagaataagaagctagcagtaaaagtcaataagccagcaagaacaagtgtgcgtttagtaaaactttgccttaaacacgtaagtgcatgagtagagttcaaagatgacctaaggaagaatgtggcaactgaatttttttccagttctctgaaacaattttttaaaagtcagcttttaataccttcatgaatgtcacaaacattcaagagtgaagaatcactgttcatggttaagagctgtgtatcactgact

SEQ ID NO: 394381 - DNA, 237 bp, Homo sapiens
agttcaacaccagcctgggcacaacacagtaagatcccgtctctataaaaaaaggtaaaataaaataaaattagaaggtacagtggcatacacctgtagtcccagctacttggtaggctgaggcaagaagacagcttgagcccaggagtttaaggttccagtgagctatgactgtgccactgtactccagccagggtgacagagcaagaccctatctctaaataaataagcagatag

SEQ ID NO: 394382 - DNA, 124 bp, Homo sapiens
caggcagaggtggctgtatggtggccacatgggagaggctgaaaggccaccatccaggtggaagctgtatctgcccagcaggcacttttttttttttttgaaacagagtctcgctctgtcaccc

SEQ ID NO: 394383 - DNA, 498 bp, Homo sapiens
gatgtgcagtgcgctgcccttccgaacaccggtgtgcacagcaggcggtttaggtgactctgcttcccgccaagaaaggcagattgccacatgcagcgcctcatttggatgtgtctggaatcttgactaccctaccttctcctacaaatggaccttgagagcttgtttggaggttctacaagggaagcccagctcttctattgggtatggtcgttctcttcgactgagctgcagcttcgggagggacgcacatgaagcagtgaggaaggaaggggacacccgcctagccagccagatcagccgaatcaaccctggcgatcaatgggatgacaggtgtcgcagccagatcgccctcatatccggtagttctacttttaaccttttgtggaatctccatagttttctgcggtgctgcgccatttacattcccaccaacagcgcacagaggtttacacttgtacatgtttccaatgacgaactaaaaactttcatgttttc

SEQ ID NO: 394384 - DNA, 462 bp, Homo sapiens
aggacatgacaggcttgaaaacttgcccccggctactcaccttccagctgtgatagaaaagggcttggttcttcccctgcttgtggagtctgcacaccggatttgcgccctcccctgagttctgatcaggaggcttcttgcctgttcaaattgttacaaagttcatctagagatttccttctccctgtggagctttaccccctgctcctctggtcatcatcccgctggatccctgtggtgccaggcaggaatagcctgtgaggggacgcagccagctccccgggcctttctgctgcttcctctacccctatatttcgctcggctctctaaattgactcaactccaggtaaagtcagaaacttgtcctgcaaacagaacttcagcttctccaatgggagtgtgtgttcaggagaggagggtctccctttcccatttccgctgttcgggcgctcacagtatttg

SEQ ID NO: 394385 - DNA, 316 bp, Homo sapiens
ggcacgagcccacctcagcctcccagagtgctaggattatgtttctgtaattgtaatacatttattgtttttagaaactgtctttgctttagtggtaattttcaataaaaatagaaatagcagtggagttattaaaagagcattagttacatttttccctttttcattatcttcaaatattatatatagtaagtttgacctttttaaaatgtatacttgtatcagttttaacacatacatagattcctgtaactgtcaccactataagggtaaagaacagttagttccttcacctttgaagtcaaaccccacctct

SEQ ID NO: 394386 - DNA, 173 bp, Homo sapiens
gacagttatatttaccagtagaactagaagggaatgcttcagtctatcctgtgtttagagtcatggagttggaggaggtttgggtgggaatctgagtgacagccaaggagaaggagatagggccgtcttggggttttctgcagtctcagactctgggtctttgtatgaccctt

SEQ ID NO: 394387 - DNA, 210 bp, Homo sapiens
ctacaggcatgtgccaccaggtcgggctgatttttgtatttttatgaatagtaggatggggttttaacatgttggtcaggctggtctcgaactcctgacctcaagtgatccgtccacctcgccctcccaaagagttgggattacaggcatgagccaccgccctggccctcaaaaaaacgctttcatctgaccttgatataaagatatgtg

SEQ ID NO: 394388 - DNA, 174 bp, Homo sapiens
ccacctcagcttctcaagtagttggggttacaagcacataccctccaggtgtatatcaccatgtttggctaatttttaaatttttctgtaaagatgggggtctcactttgttgcccaggctgggagtcacaacttttttttttttttttttgagatggagtcttgttctgttgc

SEQ ID NO: 394389 - DNA, 120 bp, Homo sapiens
tccatctcaaaaaacaaaaacaaaaacaaaaacaaaacagtttctgaattttaaaaactttaaaaagtgcataatagaaaaaaatggagcagaaaaccggttacatttaattaaatctta

SEQ ID NO: 394390 - DNA, 693 bp, Homo sapiens
gttcttacaacctgcctgttgttcttcagaaaccaaattccgaaatatcatctcacaggcagttaaaatgctaaatgaggagcactgggttgagaatggtgtagtaaggtgatggttgggggatgtcagcaggactcaaagacctgggcctcagctgtttctctcatcagtttgctattttacacattgacttgagcatggacgagagtgttcaggagcaaataccttttaggtagcagactgagcatgtgcaggtttgactcttcttgtgctcctaggacagagcaagtttcattttgagggatgggaggaggtgtaccttgctgtatctgagatggcaaatgcaaggcacgtgttcagctatccccatatctggcagacattgctaatctatgatggctctctttctgagctccaatagcctcagaatcctttcaacagagctttctggacagccattatcaaatggcaggtgttggcacaggagatgaagtctgtttgtcaagatttgggctaagtagtagattctttcttgaaaaaaaaaaaagtgtgcatccgtcacatttgtgggtaatccaaagcccttttttagtttaagtgcaggacaggacttgactttatagaaggacacagtggggatcatttttcttctacatctgaagttatccatgtcccaattctacttaaccacgt

SEQ ID NO: 394391 - DNA, 368 bp, Homo sapiens
attcgggtactcttaaatacaattcttaaaggaattaaagtatattcttcataacaaacttaaatacatacttaccttcacttttttccaaatacgttatactttttttctcacttaactctcatttgacattgtttcctgttaccattattttccctttagtctgcttactgtcagtttctgtcaaaaactgtgtccctactcttaaaaagtgctgttctcaaaattatttggtctactcccctggttttccctgcccttccccatctccttctctctcctctcccagtcacccttccttttacacactcttctaagtgatcttgttaatactgaaggtttccttttccttcatcacttatgaaata

SEQ ID NO: 394392 - DNA, 240 bp, Homo sapiens
gtgcccagcccaaccattttttattttaaacagtcttgtcattgaagctttaatattattaatttctaagctccaaaacctgagggaggaaagggaaggctgaagtctcaagaaagagcaaagtagtgagatgactgaaatgcaacttcctacctcacaagtttgtcttgggttaattctaaggcctaaaaactaccaagtatccactcagtaaatagctgttgaataaatgaatgaaca

SEQ ID NO: 394393 - DNA, 437 bp, Homo sapiens
aaaagcccactaaaatatacactgtatatgtgaatatatacttttaaaataaaaaatgccttactctacacattaataaaatgcttttgtgacgaatacaatagaatgtttaataattgggctacatttgacatctttaggcataacctatacctaaaacaagtgaaaaaagttgatgaattcttaccccatcctgctaagccttgcccttgcttgggtggtaaatgattttcccctctcgccctctatgccagcatctatctcttggtagtagctgcacagagcattgtgttaagaaggactttgcagctgagtctgcattcaggggaaagattgccgtgtttttagctgtgacttctgggcataaggcagggagagcacagcatggacattgtgtttgtcaccccttagtgatagagaagagttaaaatcaagag

SEQ ID NO: 394394 - DNA, 378 bp, Homo sapiens
agaaactatgaagtctgagtaagttatttcaacattttgccttgatatataagcaaagactaagaattaataggaaaatgtaattattttttggcctgctttgaaaatgatgctcccttggctaacttaactactatatctgggaaagtaacccaaaaaaaaaatttttttttggagatggagtcttgctctgtcacccaggctggagtgcagtggtgccatctcagctaactgcacctccatctcctggcttcaagcatactcctgcctccagccatactcctgcctcagcctctgcgtagctgggactacaggcatgggctaccacgcccgctaatttttttgtatttttagtagagacggggtttcaccatgttg

SEQ ID NO: 394395 - DNA, 260 bp, Homo sapiens
agaaactatgaagtctgagtaagttatttcaacattttgccttgatatataagcaaagactaagaattaataggaaaatgtaattattttttggcctgctttgaaaatgatgctcccttggctaacttaactactatatctgggaaagtaacccaaaaaaaaaatttttttttggagatggagttggaagtctaaaatcactagttagtaatatccctagtaggtagacagtcccacaccagactggccaggtggccttc

SEQ ID NO: 394396 - DNA, 146 bp, Homo sapiens
cagaaacaataacaaaaataacaatcaacctcataggaaaaagttcattcttcaaagaatgtaagaaaattcttactattcctgagagatatgtaagaagatattttctctatagttaacatacacaaatttcaatgggctggttg

SEQ ID NO: 394397 - DNA, 408 bp, Homo sapiens
cagatggcagctcttttagagggagttgtcagggaaggcctctcagggggctgcatttgagcagagggaagggagggagccatgtggttctgtggaaggaagtgttccaggcagaggaaccagcaggtgcagaggtctgaggctggcagtatgtctgctgtgtctgagaggcttggagcagaaggaatgaggagcgtggagaggtgagggcagagcggggagtagggagcaggtcattggaacctggaggccagatgagggttttgatccaatagctcaccacctccaggaagttttctcaagtcaacacttctcccagcagttgatctgaaccaaccaatggcttcttgcaaactgtcctcacctcctgcgtgtgtctatcttgctggaatagaaccttcccaaagg

SEQ ID NO: 394398 - DNA, 259 bp, Homo sapiens
caggggggccttgggagcccaccaggcagggatcagcaaggggtctcactcagcgagggactgcaaagcctcacttcagtctctaggtccagggatcaggctcaccaactccctgcagaggccccagcagcaggggaccgcaggctcacagcatggacagtgggtgatatctgttgtaagctctcctcttccctctcccgctccccatggcctccgctatcagaacatattctgcctcttgcaatatggacagagtggg

SEQ ID NO: 394399 - DNA, 317 bp, Homo sapiens
atctcagggttgactcagtgaaactaaattaggaagtgttataataattttccatctcacgtggttcttacattgaaattacagacatgcattcacagcaccacaaatttctgtttttcctataagcaggttgactctagtttattatacattttttcaagttttcctccaactaaattattaatctttgactgatggtgatgtcactcccaggattctctacaaaaaataaaaccctcaaataaaaatgccaccaatgagttccaccatgtagtttctcatgctaatatccatatttgattctaattaactgcatg

SEQ ID NO: 394400 - DNA, 276 bp, Homo sapiens
tggatagtggtggtgattgcacaacactgaatatacttaatgccactgaattgtacacttaaaaatggttaaaatggttaattttatgttatgtatactttaacccaataaaagagataaacagagagtgcttatgaggcaagttaagtgaaaaggcaggataccataggtctaaaccatataaaactacatttgcatttttttaaaaggcgggaaagcagcatactaaaatattcatggtggtttatctttgaggggtagtgttggggataacat

SEQ ID NO: 394401 - DNA, 583 bp, Homo sapiens
cctggtcgcgctgtgccgggtgtgacactacggagagcagattacattatcaaaagcaccaagttgaaacatttgcaaggtgtgcatcatttcacaattattggcaatggttcaatggtttcatctgctttgaacggtttcttctctatcattaagaggtgaggaaactgagcactaagacactaaataacttgcccagggtcatacgacagacatgagaggtttatatcaggcagtctccacccctgttccgaagtcaagaggctgactcgggttgctacttcttgacagaccggaccccagatcgccgaagaccatttggacacacttctatcaaatcctggcggtctccttctaacaggtatgcagttttctctgtagacccttaatacacagataagacttgaaggaatttatctgcattccctgattggtgtggcaatggaagtcccgccctgcatcccgacactgagcacagctgcagctttcgcttgttcattcattcagtagatattattttcatgcctactctatgccaagcactgctgttctttgaaataaaccttcgcctcacctctcacca

SEQ ID NO: 394402 - DNA, 1572 bp, Homo sapiens
aaagtatcaacgtcctaatctcatgggcacctcttgggtctttccatttttgccttcatttgctaagtggcatgcttttgattttttgagatgaaactttttcccagcaaagtcttttccccacagtgatgctctgaaagccaggacacctagcacaggaccctgggcatagtatgcactcagtacatgtggagcatgttgatcaggaacaaaaggagtagcaaaggtcagttcctgcaaaggtgagtagataatacaggtatgactgaaaggctgcaactcaggagtaaacattttacattcattcaagagacaatttgcaactagtacaccaaaaaattttggcttgaagcagtactttggggacttggctaaactctgtaatcacttggagaactttaaacaatactgacgtctgggccctactccagggattttgattttattggtctgttgcaatttaggttttgggaattgtagggcctccgcatgtgactgtaatgtggagccaggggtgagacccactgtttcagggtgagggatgcattagctgtgtgtgatttccatgtgtgctgcaagtatttaacctatgaccactcctgcatttggagtcttggaaattgcagcaggaggaaatgtctctctacagatctattttttatgtcacttgcttttagagtaagaggttatttcaggcacagtaatttgatttaatctgttttcaaatactaaatctgaaaatactaaaatgaaaagaatttgcaaatgtgagaatttgcaaacatgtggagtgtgttcttatgtgctttccagtttctctgatgataagaaatgagtaatgttgggccttgatttcctaaactcagccctcagtcactttctcaaattatttgaagaccttccaagttgcttcagaagcattgtccaaaggagattattcccagtagtgaagaataatagatggatgagaatgtctaaggaatcctacttctgtcgcagaagtggcactctccagaacctcaagggcccatggagttcatgggctttggagtcaggcagagttgaccctgagtcccatcccagcctcttaatagactagttacttgacttggaacagttatgcaagacaaagcacaatgatactgattgcagtaatgggaacaattcattcctctctgtatccatgccctttgcaatgcatgtttttagctactcccatggagggaaagattctgtttttccagtccttggatctgactggccttatttgctgtggccaattcatacttactgttctagtgaaacaattaggcatgttttgctcctcattctagactttaattaaaattaaaattttatgatattttatttctactgtattttgctgtattcattctgctcagtattctagttcactggtcctcttatctctgtttaatttagtggtgaacctatacattgtctggtaacttaattttgtattttcgtattctattgggctgtcgttcaaatgtggcttttaaacttcagttacttgttctttctacaaaaataaacattgattttctactt

SEQ ID NO: 394403 - DNA, 394 bp, Homo sapiens
gaaggaacaaagaaatccatagctggttgtgatcaattaattgtaaacacaaggaatttatttcttaaagcaagaagatatattaaatgacaatctcaagtttcccaagtcaagctaaaatcagattatatgacaaaaccctcttctttctttgctttaacacagagaacaaaggaagatgctagtactaataaataaacattaacagatccatgggggaaaaaaagactacacagaaccagttgtactttagtggctaacaatttattgataagtccagactaatcttaacacagtgagccagaaaactgagaatttagaggatgctgtgtggctccaagagtgtttcctcaaccactgtcctacagacacacaaacagtttacctagacacc

SEQ ID NO: 394404 - DNA, 205 bp, Homo sapiens
atctgctattaatgactgaattcagggattctgtgtaccctcttcccacagagcatggaggggttgaataacagaaggctgggctgagctggttttttcctgtgtctgactctgggctccctctgagcgcccctgtgtgccttccctcaggcccctcttctgctcggagccttccctggctcgctgctggctgcagtgcctcgtc

SEQ ID NO: 394405 - DNA, 273 bp, Homo sapiens
cagtaacactagtcagaggagaaccgttctgaatggataagtgggttttcagggcctattagtaagttacttcagtagctggtgctcactggattgtcgttcattgaccttattctcctagacactgcagctcagtgttgcctgtttgcatctagaaatggtggatttcagtactgggcaaacaaacaaagtatgctaaatgtcactgtaaatggaggaggaaatgtaaccgagaagctagatcttaactggtacttaggaatttattcaggt

SEQ ID NO: 394406 - DNA, 443 bp, Homo sapiens
gcggggtgacataatatgaaaagtgctttgtgatttgtaaagtgttgagttatgttagaagttttaattcgtgaatggttccacctttctacaaaatgtattaggcagctattaagtgccacatgctctggtatcactgggaaaggagatgcttcaaatgagctgcctgcccttaaggggtctactgggtgaaacagaagaaaactgcagaagagtttggcaaaactttaatagtgatatgaacaatatgctgtaggagcacagctttaccccaaggggatgagagagttgtcactgacaggcatcatttgagatgagggatggctaatgataggacctgggtggactgggaagcaaggaatactcaacagcaataacaaaggcaaagagttgtgaaatatcatcatatgtgcagagattaatgaattctgtgtgattgtgac

SEQ ID NO: 394407 - DNA, 492 bp, Homo sapiens
gtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgt

SEQ ID NO: 394408 - DNA, 171 bp, Homo sapiens
ttctaaatgtataaaacatttactttcttttttaaaattctcaatggtcatttcgtgctttattcccctattaaactgaaataactttgcttataaaagtaatataggccgggtgtggtggctcacacttgtagtcccagtgctttgggaggcaggaggatcacttgaggc

SEQ ID NO: 394409 - DNA, 535 bp, Homo sapiens
tgacttggcctcccaaactgctaggtgagctaccacacccagctaagttttgtatttttagtagagagggggtttcaccatgttggccaggctggtcttgaactcctggcctcaagtgattccccctgacttggcctcccaaactgctgggtgagctaccacacccagctgagatcatttaatttttgatcacaactattgggagtattttaaaattgtaattgacgtagactggtatgacattggggactgatgatatggaatgttattgctgattcttcagtatgtggacttcttgcattatgttccatatattcttaaaagaatggggctctcatataattttatttcagatatgtccattatttctggactgttagttatgccatttaaattaggtatagccttgctacctttttccagcttatcagttttaagaaagatatggtaaatttattcaactaatggtaaacactttttctaaacattgttctaggttctgaagaatcgacagtgattgaagaaacaaaaacat

SEQ ID NO: 394410 - DNA, 346 bp, Homo sapiens
gagctggtgatgaccttgaggcgcctagccagggcacaggcagggttccgaaaccgatttctgtgtggtcactgcattattgccttcttactatgactgcgtgtcaagcggcgtggaaaccttgggacagtcttcccttcgcatagccgtgcgctactgtacacacatggcctgacgcttgggcggagagagtactggtcaccacgtggaccctgtccttgcaacgtgctgtagccagaattcattttgcatccaccggtctcccacggagtagagtccaggacccttcttatcccagccacagatcatactgcccatagagaggcccaagccacggtcaacccac

SEQ ID NO: 394411 - DNA, 234 bp, Homo sapiens
tggtctaatggcaaagattagaggtactaaaatacaatgttcgaaaagtaatggttggttgaatccaggacatagaatccctgggttttggaaaaattgtcttccttggataaatgccaaagcaacttcacattacagccaaggagaatggtaagatggcaaaaactgaagaggcttttaggtcgccaagagggctgatgtaaaggaaacacggcggtgtattcaggattgaag

SEQ ID NO: 394412 - DNA, 437 bp, Homo sapiens
ctgtagtcccagctacttgggaggctgaggtgggagaatggcttgagcccaggaggcagaggctgcaatgagccaagatcgtgccactgcactccagcctgagcaacagagcaagaccctgtctcaaaacgtatatatatagtactgggtggagaggcccagggcactccctggaggaggggatgtccaaggtgaattttgaaaggatggctataggaacccatcagagaccggaagcacagactgaaccagagagaggcggcacagcacacacacgtccagcacaggcgctaatagtcatgcccgcggctccctgaacacctgtgtatacatgtcccccctcagttaatgctcccgccaatgctgaaagctaagataacctgaggagactgaggctcagaaaggtcaagcaacctgtccaaggtcacacagctcat

SEQ ID NO: 394413 - DNA, 329 bp, Homo sapiens
agccacacactgcacactaactatactgcatctttccaatgtggcaccttttctgcattcccatgtccttccttcagacacccatcactctcttggcctacttgtctctagcatcactacctcccaagccaatcttcacactttgccagtgttctttctataataaaatgtacttcttgaaataaaattcaaacccctgagcctgtccttgagactaatctagttgaggcctatctcatcttctaacacttcctacatgcaccttcaaaccagccctctcaaaatattttaggttcattaaacaggctatgcttttcttcttgcttccg

SEQ ID NO: 394414 - DNA, 391 bp, Homo sapiens
tgcacgggggcctgccagggggacttcacatgctcagctgatgcaggtggaggggaagggagaaggctgcctggatgcggggcctgtccaccccttccaccccatacagcatctggttctggtgtgggtcctctcctcctctttctctacacacacacacacacacacgagaaacacgcagtctcacacgtctgatgctgccccacacgtgtcgccaacatcagcctttgtccagcctcagcctctttcctctctgagggtttggccacatccactggcactgcatttcttccctgcaattttgctacgtctaagtattgtctctattatgatctagtttttgtcaccttagttgacttgttaagctgaaatagttatttcaaaaggaacc

SEQ ID NO: 394415 - DNA, 561 bp, Homo sapiens
tttattgttgttaactgtgcatctagttcattagaatatatctgtcaaataaatatagccctctcaatgcagtggatttttattggaaacatgtttaagttagattatgtagaaaatttactgccttatttttaataagatctaagcccttttgaaaaggcatatggtaactgaaacatttatttcaatccattataatacaacaaacaagccttcagcatcatctgtgtgtcacctatcaagcagtggattaggtgccagtatggcaaataagaaagatctacaagacttgatcaatcagtccatttcactcctggagttcgaatggagtggaagaggtcaggagattaaaagactcacactaaactctaccaaaatattataagacattcagtgctatagatccagatcttaaactgtcatggaatgtacccgtacaggagggatgacttttgcttagagtggatcaatgaaggcacctagggatatgtgctgtttgagttgagctttgagtaattaagtcactgggtgtgggaaataaaagcagaacacacacgtatc

SEQ ID NO: 394416 - DNA, 709 bp, Homo sapiens
ctccagatagctttatgctttctttggccttaaagccttgcttcctttactctatgcccaagtctagctcaatttttacctgctggcacatacttgggtaaggggattctgcctgtcttgctataacatatctcagagcctcccagatttgtcacaagaaagtgcaaccagctctgaccctgttggcttctccttcctctgggggctctgtcccttggcaaagctctcctttcaaagcagtggcctgaggacggactcaaagcctttccttagttctcccttcacatttaataaatacagaacagcacaggggtgaatgtccaaactggaatcatacacttgaatttaaataccgaatattccacttactagctgcaccttcaagcaagctccttaatctgaacttgttctctcacctgtaaatgaggacaatagtcatacctatctcatatggttgagataatgctgcaaagctacaataaaatatcatgtacaactttataagctaaagaacccagcaaatgttaatgataacagcatctacaggatctgccctattgcctctctgacttcatctgctactcttttcacttctactccagccacactggccgccttgctggtcttccacaccctgggctgcccatgcctcagagcttttgcactggctagtttcgctggctagtatacccacagatgtccacatggc

SEQ ID NO: 394417 - DNA, 486 bp, Homo sapiens
ccataaaccaaccatccaaccaccagtctacccacctacccacccaactaaccatcatttgggctatatctatctgcatatcatacataatatccttgcaggaattaatccagcatccatatgagtgtaactcatacctaggctgataacaaaatctgaaaggtttttcactgaaatatatcaggtgactaaagaatttcacaacccaaaagaggagggtatatcgatcctagtggaattctatttcatggattttgttctgcctttattgacacagttagacattaaagagaataagtataataacaaaatttataagaaatgcttatggaatattttctaattttagctacaatgatgggttgtttatattctgtggtttgatttttatatcaatctttatgcagctattatcattacccaaacaagtagatattattgcccctttaataacagtgaaggaaactggaatgtaagaattgaggt

SEQ ID NO: 394418 - DNA, 370 bp, Homo sapiens
ccaggcgctgttgggggtacggggactgttgtctcagtggctcataaccaagggcagcggggtcacaggcctgggtattgtcaccagatgggcaaatctggatcctctggcctggaaaagctctcaaaccctcccaactctcaggaagacctcagggcattcgagcaggggaagagatgaggcagcaggccttatcatgggggacataaggagtgggggtcaggagtaaggtgcagggttaacaggactgaatctctgggggcaatgccttagttttaaggctgtctgcattttcactccggcgcttggagggagggcaggagagtgcagacgtgagattaatctctccaacaagcgcctggagcagaac

SEQ ID NO: 394419 - DNA, 216 bp, Homo sapiens
gaggatcttagagaaacagatagcttgccctttctaccttgcatgaaggggccttcgtgttttccggtagatggtacctgccctccaaaccaggtgggatgctaatctacctttcagctctaaagttctacttgcattttacatgtttctaccactggatgagggcatgccactggatgagggatgccactggatgagggcatggggtaccgagct

SEQ ID NO: 394420 - DNA, 545 bp, Homo sapiens
ggcttgccaggagcccagcaccaggtcctctgcagctgccagggatgaagaccccagaaggcacactgtgaatgccctttctccacaattcagaatattctctctgcctgtgtcggcgggtaggaagaaggctacttttggggacctacactgccccacaccacagagagctcctctttaaagagcttgcttctcaaacatccaccttttcaaggtaaagtctctcatcgtggggagctttgaagacgctctgctgcacggctgggtgcccttcaatgatgggctcgtcaaattctcgaagaaaatgacctgatcatttgaaaagcttaacgcctgcttaataaggcaccaaaaaggaacaagagccagttgccatcgttagaaaacctatctggaccaccctaaactgattttggggggtaaatactgacattttaaaataaaactttaacccttttaaatatatccattgaaatctgtaaaccgtcataatttgttacccgccatcatctattaaagaatatattccaatttatttattggga

SEQ ID NO: 394421 - DNA, 353 bp, Homo sapiens
gcccgtgtagacccctcaacctaaaactgctgcatttgagtcctgagttgcttgaagcccctacctgcatatcttgccccagaggcagcaggggtgagttggcagctatttggggaggcacgtgctgcagttgagagcacaacggctttccattattctgaggcagttgactctgcagctgtgactgagccgagggccactgcttctctagatcccaaggacccgagtccattggcagctgttcctgcaacatcatcccctctgagtaattctgaggctgttggtgctgctgtgggtgatactgccaatcattctgctgctgttcttgcagcagtgagagacagaatgagcaa

SEQ ID NO: 394422 - DNA, 623 bp, Homo sapiens
ttctctttctgagcaacttaggcaattatgctaatttaaggtaagagttttaaataaaatcaaatcaaaagtaaatttaaaaatttgtgatgaactgtctttctcccaagaactgtctggcctaggaaggcaatgtctgacaaacagcaagagttcagtgagttctgaaagaatgaatccatgaatgagtgcaggaacaaatcaacttcgaatgacaatctgctctacttctaactgaatttgctacaaatctcaccagcctaatgaagactgctactgaaatggacactcattaatcacaatatcagttcccactgcactccagtttggatgacagagtgagacctcatctttaaaataaaaataaaataaaatcacaacatcgggtgctagagccatctggaaaccatttaatggaaccccatgcgaataaatgcatggtccagggtcatctgagacaacgacatttatgtttttaagcaaccaagatgccacagtcagaggcaagaatccattcccataattaaacatgaaggactactctgaggaagtgtattcttttcttgaaaataaatttttgaatgcaatcaaaatcaatttcctttcctctggtcctcagtgaa

SEQ ID NO: 394423 - DNA, 136 bp, Homo sapiens
gtggatatccagttttcctagcaccatctgttgaagagactgtcctttcccattgagggtcccatcttggcaccctcgttaaagatcacttgacaccatatatgccagggtttatttctgggctctttgttttatt

SEQ ID NO: 394424 - DNA, 283 bp, Homo sapiens
gttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgac

SEQ ID NO: 394425 - DNA, 391 bp, Homo sapiens
tccatccccctcagcctcccaaagtgccgggattataggcatgagccaccatgcctggcgtgagccactgtgcctggcctgagctaatatttttaaggctgcatgccagcctccctgccctttttccctcttgaaccactcttcatgctttttatgctcaagcagtgtccagagcttcagaattatttttcccttactcacaccccattggaatctggagggctttcttggctggcttccccccgcaataggtcagaggtccctgattcccagggaccctgcccaagagacctgcgtctccccagctctgcagaaggttgaggcgtggtgggtgggagttggtgtggtcagcgtggtctggtagggttgggaatagccatggcaatggaat

SEQ ID NO: 394426 - DNA, 367 bp, Homo sapiens
gggcataattctcctccatctgtgcacttgcgaacctagaaaacaagttatctgctcccatgtatgatggtgtgacaggcatacagtaacagctatacacattcctgttcaaaaagcagaaattgggatgaaaaaaggagccatcagcaccatcaatttacaaaaccagccaggcaccctcctttcagtttcaaggcctgggagtaatcttcagctcactgctcagttctctgggcttgtgactgtctcaatcatctttactttttcacaaaaggtagcacatgtttgcagctgagtatcagcttatcagtttgtttcttcttttatattctctaaagcattctgttaaaaatagtggtgtttctgc

SEQ ID NO: 394427 - DNA, 325 bp, Homo sapiens
gctctaataaacttactttcaattcactgttggcccattcatgattccttccagtgcgaagccaagaatgctcctgggctgagccccaatttggggttcacctgcgtcattccttggtgaccatgaagagaccaataataagccaaaaggaactgagggagacctttagccagaccctaaattaagactgattgggttgagcaccgtggctcacgcctgtaatcctagcactttgggaggccaaggcaggtggattgcctgagctcaggagttcgatactagcctgggcaacagagcaaaaccccggctctactaaaaatacaaa

SEQ ID NO: 394428 - DNA, 381 bp, Homo sapiens
cctgttattgcaacattttgggaaaccgaggtgggtgggtcacttgaggtcaggagttcaagaccagtctaggcaacatggcaaaatcccatctctacaataaatacaaaaaattagctgggtgtgctggcttgtgcctgtagtcccagctaccagggaggttgaggtgggaggatcagctgaaccctggaggttaagactgcaatgagccctgggcccatcactgcactccagcctaagtgacagagtgagaccctgtctcaaaacaacaaccacaattacaaagaatggggagatgagcacaacacccaaagttctggctctgcaacatgagagaagttgccatttgcagagaagaaacaggttgagaggaaaatagca

SEQ ID NO: 394429 - DNA, 671 bp, Homo sapiens
agtgggatttctttttcgagccataacctgccttggaatctcatgggcctatttgtgtcagaaaagtcggtgctgcccagatgggcttttagagtattccagacaggcttctacttgccaacacatagcacatctctgcacgtccccaacccttggtttctttctgtctctctctctctctttcttcctttctgtatttctgtttctctctctgttgtttttcattaacacttatcattgtgacccagtatgcctccagtaagacacactgcaagctttggccatgcccacagtggccaccattgctgcccttagaacagttgtccttttgtctgagaagcagtcacaaaccatcttccctggcatggcactcgctgggtctgaagctgcccagttaattttgcagtaatgtttgtggactctggcaggatgtgcagacttatcaagtgttttattaaaagaccaaagaggcttttgaatgtatcaaagccataatgctcttcaatgctcatattttagtagcttttttttcatacataggttctgtgcattatttgtgtctgtctgcagaatggcttatttctcatttggctggtggcttgtgttactgtgtgtgtccccttgggcaggactcaccacctctcaggattctggcataacttatttgaatc

SEQ ID NO: 394430 - DNA, 610 bp, Homo sapiens
cgctctagaggaccccacgcgtaaagtaactctcacaccataattaattagaaatcaataacataaaaaatttaaaaatccctacaattagaaatgaaacaacatagtttcaataacacatagggcaagtaaatagcctcaagaaaatctttaaaataattttagctagagaaaaaccaaaaatacacctaccaaaatttgtaggatgcaacaaagtctgattttggaggaaaatttatagcattggaaacatatactagaaaaaaataaaattctaatatcaataaactaaagtaagcctaaatcaagaagaaagtgaatagtaaaaattaaagcaaattcaatgaaattgcaaatagaaaattaggaaagacattaaatgcaatcaaaagctgtttatttgaaaacagcaataaaattaataaacttctatccaggacaaccaagcttaatagacgaaatttaattgctttgtaatataccagcactggataattgaaatttggaatttaaaaaaagaaatactttggtatatatatctaatatatacaggacctatatgagtataaaactctaatgaaagaaattaaaaatgatccaaatatggaat

SEQ ID NO: 394431 - DNA, 295 bp, Homo sapiens
gaggatcacttgaggagcccagaagtttgagaccagcttgggaaacatagtaagactctaccttcataaaaaaattgtgcacacttgtatgtatgctttagatcctgtttgttgttgttgttgtttttgttttggtttggtttggttttttaaagcataagactgatgctttgttacaaagcattcctttgggagcatgcctgggaccttattagaattaacattcgttatacatattggtaggtaattaatgcagtaagaactcttccctttgtatttattagatgcaaagaag

SEQ ID NO: 394432 - DNA, 260 bp, Homo sapiens
atcagctcggtaccggtgtgtcatgaaacaatatccaacaaatgagaataagtagataagtactgtcttttaaaaaagtgtacttaaccatttccccactctccttatcccctggtgtggtgacggctgtaacccactaactgctggtaactgcccttcagagaaatgcatcccaggtgctgaatctgtagagagtgtgcattattctctggccccttctccactacattctacatttgtttcatgacacagattttttt

SEQ ID NO: 394433 - DNA, 471 bp, Homo sapiens
acctctgagtccaaattgcccctttttataaggacaatcacattgtccttagtcacattggattggattagggcccactatacagaccttgttttaacttgattcttctatcaagaccctgagaatctccaaataaggccacattctgaggaactgtgggtttggacttcaacatgtcttttttgggggccacaactcaacccataccagcttgcttgatggatattcatagctgatgtcaaagtaaatttaattctcatcctcagaagcaagaaagattccacgactaaggccaacaataacatccagggagttcgtttcttgagcaacgaccagctctttgcatagcacgaattgccaaaaaaggccagcgtagtcatttctcggccatgcacacctgtgatgtggcaagccatgttgacgtgccaaaaatgagaattctccagtaaaaataaaatagagtaaattaga

SEQ ID NO: 394434 - DNA, 325 bp, Homo sapiens
agttcgacggagactctctactcgcctaattaggaaatggtgtctttaggcgagtagagagaaaataaaatagaaacagattgaaaacaagttgcaaacatgagcatctgtgcctcatttcactggtccagaagtgacaggtccttggctgtgggaagcaagcctaaaagtgtagagtcagtgtggaattcacccacagtacagtgtttctgtcttttttaaccgacttccaacgatattctcttactctaggctggtctgaaggtagtgagttatctcaattgattgttcaccgtcagttacagattgaattcctcattctact

SEQ ID NO: 394435 - DNA, 237 bp, Homo sapiens
taggagaaaggacctggggtgtctcaaatgggtgcaagcatgacaaacagaagatgttaagagtagatatttggaatgatgaagacaatttccagttttctctaagaaggtgccgaattgcttgcaaaatagtctccaaggacaaatcatagatctccaactaaagataattaaaagagttaaatataacatgcaaaacaaacaagctgatgaatggaattggaaatttccaaccat

SEQ ID NO: 394436 - DNA, 305 bp, Homo sapiens
gaaatgctcctcacccctgggcccccataccagcgtttctaaactctcaccctgtcctgtggggctgtggtggtctggtctactgactcttgtcctgcagcagtttctagcagcaggcagaggaggcgctggtcctcactacccctggtgggtttgcaaaatggccctgtctgcatccttctcgcctcaggtatatgtgttgttggggccgcacaggcctgggcttggtcagcatgtacctctgagtgggctcttctattggttgctcaggcctctcttggggtgggccagtcaccttgtgggca

SEQ ID NO: 394437 - DNA, 167 bp, Homo sapiens
cccctcttcccaccagcacagacaccaatgggaattaaccccttcacttttcaaactctgcagggtcttgatagccatgcaaagaacttgaccttgttaggtggaagaattggtcatcactgctttaggatgggatgatcaagctagtgtctgcttacattggacaa

SEQ ID NO: 394438 - DNA, 317 bp, Homo sapiens
caagatggctgactagatgcagccagatggaacacctagctgcatgttccatctaagatgactggcgtgctcctaacagatcttcagaaggaaggcactgagagtggatggaggaaagacacaagaagctgggctgaagggggaggacaatgggaaccctgcatgaggctactatgcattgggattcattcctggtccccagcaacttcaagggaatgagtgagttgaactagtaaggagcaagcccttcttggcacaggcccctggaactctggcaggaggagacccatcagccaccacagacacaagttggcagg

SEQ ID NO: 394439 - DNA, 270 bp, Homo sapiens
gataaggctaggatattcattatatgaaaattctacttttataaaggcttggaattatccgtaattaaaacatttcaaaaatcttccacgagctcaaggagactccaagcctatggccctggatcacctccctgagacagctggagcaaatgtcaagcccagtgttgggatggcaccagatggggtgcatgtagcttgggagaccttccttggccctaaaagggagcactgtctcccccacacctccccctgctgggcagcatgggcact

SEQ ID NO: 394440 - DNA, 537 bp, Homo sapiens
agatacatatcaaagaggtccatacttaattttcatgttcattcactgtgccaattgagttctcatttcaggactgttacttattttgtgatatatctttgtaatacttttcttattccactgttgagttattttttcttctgagacatcagttaacatttgttgggctctctatttttgtcctccatatctagtagtttctttatgattctttaagcacctcatgttatttgcattactgtaattatcacaatctttttctaaatgtaagtatattgattttgttttctgctcttttgatcttatttaacttgtgtttttagcttgcttaattttgatgacattattttggttcttatttcctgtttcatactacagcattctttatattctaatctttttgctctcattttgtcaaattcaagtggctattgtaagcttgtcctattactcaaagcttttttgaaaatgttccttcttactgcagtcgagtcatataaatgaataaacaacaaaaatatacaagagaattttttt

SEQ ID NO: 394441 - DNA, 423 bp, Homo sapiens
  misc_feature (419)..(419): n is a, c, g, or t
ttgttttcaggaaatgagaattctttcggcaaaaggagaagctgatttgcagaagtgctgagcatgcctgagagagatgggagtgatcaagaccaagagtgccatttggatgtgcagagttgaggtgacatctgcctggagagattcaggaggcagctgaaatacactcaccagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttgggaaatgggtttntggg

SEQ ID NO: 394442 - DNA, 376 bp, Homo sapiens
  misc_feature (372)..(372): n is a, c, g, or t
ttgttttcaggaaatgagaattctttcggcaaaaggagaagctgatttgcagaagtgctgagcatgcctgagagagatgggagtgatcaagaccaagagtgccatttggatgtgcagagttgagcagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttgggaaatgggtttntggg

SEQ ID NO: 394443 - DNA, 188 bp, Homo sapiens
ggaagacgtcacctccatcccaggtcccgctcaatccacaatatcaccagacatctccacaagaaccgtcagctggttctctacatcccctgtcatgacagaatcagcagaaataaccatgaacacccatacaagtcctttaggggccacaacacaaggcaccagtactttggacacgtcaagcacaa

SEQ ID NO: 394444 - DNA, 325 bp, Homo sapiens
gcataaaggtcaaagcattttagtgtgctcacctttcattataaccacttaggcttcttgataaaatgcagattcctatgaatctgaattgctaagggcaggcccaggaatatgcattttttaaagttctttatttggttatttttgggacaggatcttgctgtcacctaggctggagtgcagtggtgcgatcgtgactcatggcagcctcaacctccccaggctcaaacgattctcccacctcagcctcccaagtagctgggactacacccagcatgcaccaccaaacctggttaattattttttgtatatttttgtagagatg

SEQ ID NO: 394445 - DNA, 705 bp, Homo sapiens
gaaaaaatattttctcagtgtttggtgccaccagtggttttataatagcccttgtattaggagctgcaactttaaaatatcggcttatttagcatctacaaatgacactttgttttaatttgcatttcttgggttattaataaggttggacattttccctgtacttatttgctgtctgaatttagaggatcattttcagcactgaacttttggttattaataaatcttcaagtatgataccttatggtatcccaaaagatatttgttatgagtgttaagtgagatatgatatgttagtgcctgacccatttgtgtctggaaggtataaaatgcaaaaatatattgtatctttcatacctttttttttcctcaaccttgggaactgagaaagtatgcttgttttctcattgaaaatactaaaaataaatttttatttcaggtaatttgatacaacttcagtgttttcagatgaattaataaccacatgtaggagatattagaccctgaagtttaattcttttgtatggttttaattacataaagtatgtatgtagacaagagtcttcagatacaataagaaaaaaaaaagaagttaattgcattatttcaatttcaaaaaataatttctaatccctgtatgcctttaggtgtaattcaaaaagatttttgctaatgttaataaattccattatttttagcttatca

SEQ ID NO: 394446 - DNA, 437 bp, Homo sapiens
ctttgtgcctcccaaatagtgcagaggataaaactgttgaaagcatcaaggatgggtagagagcgccagcctccaccaaccttatagagctgaaggtgggggcggggtggtggtctcagtgcagctctattgttaaaccagtgggtgtaatgggctactcgaagttgggtccctctgtgacgaaaccccccccgccccggccaagtccacttagatatggtttcttaactgcttaactgcttgactcttagttgctttacaagttaccgcttagagggagacaggatcaggtgtcctccatcctggccacttgacacaggagtctgtcccaaggaaacagtctcaaaccaggcagcagagttacatcagaacgcttggaagcactttttgaaaatatagagtcgcctccaacatcgctcccattctcaggtcccctg

SEQ ID NO: 394447 - DNA, 242 bp, Homo sapiens
tgcccattcagtatgatattggctgtggtataattttaaatagatgtctatttccttagctaaactttacacatgtgtactaagcgttctgttaaccaagagtatggattctgaggacaggctttggcagaaatttcatgacaaaattagaaattgtataaaagcctccataggacctgatacaaaagggactatactgtgaagaaatgtttatgtttactgagcaatattctgtctcatta

SEQ ID NO: 394448 - DNA, 466 bp, Homo sapiens
actatgttacacagctctcccaggagcagcaattctgaaggtgtcagtattgttaggcccactgcagactagagaattgagtctcaaagaaaggtcagagaacccaagtggggtccctagcatgctagagtgcagatttccgacctttcaaaccttgtgataccctgttatttgtttacttagtattcctgtcctttccttacctcctccctgcatacaactgtccccaaaagtggctcatatcatgatactttttcatgttaatttaatttcacactgtttcttgagatagctggtgataccctgtgcctgagcatcacagaaggtttataggagaaggcattagacctcataacatctgtctgccctaatctcttcatcaaagcttttaacaagctaccatcacagacaatcctttctcaatggatggaaaatatttccagaacaatattcaagcactccattt

SEQ ID NO: 394449 - DNA, 380 bp, Homo sapiens
gtgtcagcagaaactgccaactggtactgaaaaagacacatgacacgatgaaggaaggtgttcagactcctgacagaatccatgcacataggaaaggtgatgtgaaaacaaacacagagatttgaggatgttgatcttggagtgaagtgtccacacaccaagaaaccttggcagccaccagaagctggaagaggcagggaacagattctcccatagaacctctggaggaagtgtgtccctgccaacacttttgatttttgttccagtgatactgattttggacttcttgactccataataaatttcatccagttgcagtttgttacagtggccacaggaaatgaacacagttggaaaaagaacagggtatcttatagtag

SEQ ID NO: 394450 - DNA, 261 bp, Homo sapiens
agctcggaccagacttctgtcaccaggggcagttgctttgggggatggaggagaaggattttggtgaggtgtttgttttgttttgttttaactttgggaagagctggtataaaattcctcagatttaatggcctcacgagtgagcactggaactgtgttgtctgctctggataatccagagctacgtcattgatcctcatctgcttttctgcacatctgctttgggttgtggctctgtgtctcatgggaaaccatttcttg

SEQ ID NO: 394451 - DNA, 269 bp, Homo sapiens
acgaagtaactatttcaaagagggaaatgttagtatttctattctatgctttggagtagaaatgactgacaatactaggaagacccaatcacacctccatcaccccactggagacaggttcagggggcagaccccactttgttctttaataccaagagctagcgtgcacaacattcagacagcaatttcttaaaagagctccacaatcacttaatgttcataacgcgtcaaatgtatcggtctgaaaaaaggtgcatactcctcttggt

SEQ ID NO: 394452 - DNA, 374 bp, Homo sapiens
ccgacatgagcctcctaaagtggcgggatcacaggtgtgagccagcatgcgcagccagtggcatcattcttcaagtctacttttactccataagccaatctcccattgaaaagctgagaaaaataattctcaagtttcaactggttacagctgaccctctgaagtgtgggataatattggcttgatagggcagtttcagttcagcagaagggctggtgtggctcattggagcttatggaagggggttctaccagggtaataaggtcaatatgtgaatcctttgatcaaaaagacatgggcacaagccaacatggacccagagagagaatacaagtcttacaaacttgcagaactgaacagtcttgcctgggtcc

SEQ ID NO: 394453 - DNA, 208 bp, Homo sapiens
ccatggtctctttccttggctaggtttggcttcatttgatttggtttgaatgtccaactatttaacttgatttctaggagtaggcaataaggcaggagtgaaatgagaaccaaaagacagtgacctattttaaatactaggggatttcaaagagtgactactggaagggggtttaagcctagctagagagaagaaaattactacacgt

SEQ ID NO: 394454 - DNA, 231 bp, Homo sapiens
agtttggaattgtgggatacccccctgggatccagattgtccgaaaatcagtgtagaaactccacatgcacatttggttagaggtgtttaaccataactactattcacgaaaaaggtctactcattagaactgaaaatcataaaattgtaagttctacaaaaataaatcaaccttatctactgcccagtcctaccaaactacagaatgtgagaacagaaggtctgaccgtg

SEQ ID NO: 394455 - DNA, 320 bp, Homo sapiens
gtgcagcagcgctagaagctctagaaactgcttgctgggtttcgtgccatagcctgtcggagggcgtctgggtgggtccagtctggctgtgtcggatggtgccttggtgcagaaccgcgtgcctcccatctgcggccagcggggctctgtccacttccggtattggaatcaccaggcgtgttgcgtgcgtgagcatgtgcggtcttgtggacacctccaggtcctagacatgagaagcctgttgattcagaggctgcgtggtctccaggggttggtttggcctctgcctccagcttcgagtggacggatggctttccctg

SEQ ID NO: 394456 - DNA, 325 bp, Homo sapiens
aattggagtgaattctgagtaaataaaatttacaatacatgagcaatatagccatttgctagctatgtaatctggtacaagtaagctatatgtctttgtgactgtaatgccaggaaggtaaattcttgtaatcagtttctgagataatgtataaaagctcttagtgtaacctattactcataatcatcttcagtattatcaccagtactgttatttactaagccttgctattaacaaaatatgcaaaaaacctactctttatctctgaaaatttatgcaccttaatattaatctaaaactgggttttctatatttcaatcaattt

SEQ ID NO: 394457 - DNA, 164 bp, Homo sapiens
agagtaggcatctgtaggaaacatcttgggtttttttaattatttgctggattcatttattcaacagttgtatatgaaatggtttttacacatgaggtcctgctaagggtagtgcttgccaccttcgtggagcttacatttggcaggaagctgtattacactag

SEQ ID NO: 394458 - DNA, 482 bp, Homo sapiens
aagcattcacgggtgtgaaatcctggccctattttcaccaacactgtcaagtaggtttcttccacattcagtattttgtccatataccatttgtgtttttaccatgaattgttcgggaaaaagtagcaggtacacaggcttccctggagaggaagggcagcgtgagacgcatgggcccaggagcacaggccgcattttcattcccacactggcacctcagtcacctgcgtgggcgggactgtccaccccactggccccaggagcagccttgctggccatggggtccactggctggtccatggcacgtggcactgcatgtcctccctccaaggaccgcaccctctgtggatccctcagggttcccccgcccaggcaccttgtctgctccacgccctgtcctgggtctctggtctggcaggagcaggagggatcctgtcctctcagggccaggtcctccaccccatgaacaggaaaatgttatc

SEQ ID NO: 394459 - DNA, 122 bp, Homo sapiens
tttttcaaggtgggatacccaggggagtctgggctgtctgcaggagtctggatgccccttcccaggctctgcagctgaggcttacttcctgaccaggctctggcctgaactgctgggcatag

SEQ ID NO: 394460 - DNA, 341 bp, Homo sapiens
tagcatattataaagacggccaacctcttaacatggtatatagaattctactgttctgttctcaactttgatccagtcaattctgtgttttagggactatcatttgtgccactcccacaaaccaatttctaatcatatggggttctttaatttgcaagcaataataatctactctggttaacttcgtttgtagcagcaagtcccaaaccttgttgaatatcagaatcgccaaaactgtatacaaatttaaggtccagacgattttccttactaaaggaaaaggttcttgagatatgtctctaaccttaaatcttttttttttttttttttttttttttttt

SEQ ID NO: 394461 - DNA, 213 bp, Homo sapiens
gttggaggctttctgaggtaagatggatccttggaacatatgagctatggttactaagaaaaaataaaaactagtagtacactttattggctgtatgctggaggtggaaggagcatacactgtttgctaaacaccgtgccagcaaatgggatttcaacatgagtaaaacagtcttaacccttaagacaatcacatttgagccaaggaggcaga

SEQ ID NO: 394462 - DNA, 334 bp, Homo sapiens
gctgaacctttaaaaaaaaatttctgttttgagacagagtctcactctgccacccaaactggagtgcagtggtgcaatcacagctcaccacaacctctgcctcagcagctcaagccacctcagcctcctgaatggctgggaacacgggcacgtgccaccatgcctggctaatttcttaatttttttatagtgacaaggtctcactttgctgcccaagttggtcttgacctgctgggttcaagcaatccacccacctcagcctctcaaagttctgggattacaggcatgagccaccatgccccaccaaattaaaattttttattttatccaaact

SEQ ID NO: 394463 - DNA, 421 bp, Homo sapiens
taccctcactgtatgtattagagactccaagctcaaagagattacaatgctactgaatggcagagcaagaattgcaatttaggctggattttttaaaatccagatagtcaacaatatttcacattaccactctgactcgagaggggatcacgtggaaaaggggcaggctgcgaactgtttcaggagcttcagtggaatgcgtgctagccgagggaagacgagaggacactgcaggccggggagcaggagaagatgaaacagcttctgtggaatgcagagattatccttccttacagttaccaaagccgtatgtcgaggagtagcaaggaacgaggccagaaaaatttgacagatccgtaccacaaagggaatgcacagccaagccaaaaagagggggaaccccagtgagatagtaggtggc

SEQ ID NO: 394464 - DNA, 260 bp, Homo sapiens
aaaaaaaacccaacaatttattctgttacagttctggagggctgaagtctgagccgagtctcacagggctaaaatcaagatggcagcagggtttgttccttctgcaagttgcagcagcagagaatccgccattcgttgccccttccagcttctggtggtggcctgtatccccctgcttgtgaccacacgactgcaatctctgctccttcctgtcacgttgccttctcctcttctgtcatctaatcttcctctgcctctct

SEQ ID NO: 394465 - DNA, 286 bp, Homo sapiens
gtagctggcaggcactacaaaagcccatagcaaatacaaggagaggacaagaagagaaaacatctcagacgaggctccactgaatttatgaccatgctctataacacgtgccttaggaactggcatgattggttcttcaactacactcctcttttgtttttaagctgggctttggtataggactgtttcaagaaagaatatcatggcaaaaaaaaaaaaacctttaagttttaactaatttaaacctaaggatgaataagttagccaggccaaaacaaaacaaaag

SEQ ID NO: 394466 - DNA, 481 bp, Homo sapiens
tcgacctgggccccagttctgcttcttgaaacctttcctaccctgtccccaggtaaaccgaggtgctccttccagtaggcacctgttccacctgaggctgagcctaatgatcgctgctgtatgctaatttttataagaagtgctcttgccctgtctgtctccccacaggaatatgtttcctttctttcttataccaaatcgactcagtgctgactcaagctaggaaaacattagagatgtgttgactagattaatccagctgggcctctaacccagtgctgggatccccctagagtagccactcaccctccagaccctgtttcagcctatcaaggggcgcttagtttattcccaccagctggttcccactagctttagatagcaacaattgttacagagaagccagcttccctttcaagaagcaggaactggccagttcctgcttcttgaaactggtctttttgcgccagccggcccaacc

SEQ ID NO: 394467 - DNA, 387 bp, Homo sapiens
taatgcaggaaggaaatactgtggctatctctaagttaatacggtttgtaaagactgtttcctctacactttctgaattacctaaactttgtgcagtgatcatctatttctttcataaccaggtcctacagaagcaatgcagattgagatgaaggcctgcacgagcagtggtttgcatttcaggaaaaggactttgaatttagggaacttgaatcttttatactggacagccagcatgccctgcctttgcaccaaagggagacactatctctgtcttcaaagactgtttgctgtacaaacttcatcaaagacattcttgggcaacagatagtcgatgtctctgctcctaagatatgcagaaatgtgacagatgcgtggaaaagttct

SEQ ID NO: 394468 - DNA, 145 bp, Homo sapiens
ttgtctcccagtgataacccaggcgatgttacaaaaatgagtaactacaagagaaactgctaacaaaactgaagacacagaaatgaaatgggaaaagtagcaacactgagtcaaacgtagatggaattagagaagaaacagctga

SEQ ID NO: 394469 - DNA, 231 bp, Homo sapiens
gctgactagaggaccccatcgcgaatcacttaataaatattaaataaatccaaattgttatctaagaatcattcaggttcttagtatacagaagtggaaaaaaaaattatgacggtcttaacttccccagaagctaacattctaacttttaggctgaattatgtaacttactaggtttctctttctgcttttctttttcttttcctttttctttttttttttgagatggag

SEQ ID NO: 394470 - DNA, 314 bp, Homo sapiens
taatgcaggaaaacttatttctctttctttttaattttatttttctttaatttcccacctcagtatgaaatatctaaagtagctgaaatcatagaaacagaaagtagaatagtgattgcccaggcttgtgagagggtggacagagaattagtgtttagtaggtgtagggtttcagtgttacaagatgaaagagttagagattgttgcacaacaatgtgaatatacttaacactactgaactgtacacttaaaaatggctaaggtggttaatttaatgtcatactatttgtcacacacaaaaataatacataaga

SEQ ID NO: 394471 - DNA, 328 bp, Homo sapiens
ccttgaactcctgggctcaagggatcctcctgcctcagcttcccactagctggtactacaggcatgcaccaccatgcctggctaattttttaatttttatttgtagttagagaccaggtctcgctatgttgcctaggctgatctcgctttcctggtctcaggcaatcctctcatctaggcctctcaaaatgctgggattataggcatgaggtaccatgcccagcccccgattggactttgaggtatttttctcctctgctaggccacgggctcctttgtcatcctgccattctgagagcctagtgctgtgcctggctcagggtaggcc

SEQ ID NO: 394472 - DNA, 140 bp, Homo sapiens
cattgccgtgagagacagagtggcatttaggtaggtgtaaaaggagggggacaaatggagtttcctctggcaggtccctgagatcccaggggagggcagaagttaagagtcagttatgctttccatagagctgcttttaa

SEQ ID NO: 394473 - DNA, 311 bp, Homo sapiens
acacattcactacacccctgtgctcttagcatagccccttttggacagcatgtgctcctaaggtatctgcagaacagaatcaagcaggatgggcctacctgaggcatggcagctgggcagcacctggctgtcagtggctgtcacccaagcctctgcttaactcctatttcttaccttatccctctattctgctccctacctaagtgtgccagctctagttaacagtaggagggtgcttggctgacagaagaatatagattcacctaggtctattaagtgccgactgtaagtcaatgcatacaatgatctag

SEQ ID NO: 394474 - DNA, 222 bp, Homo sapiens
gtggtacctatagggatggcataatctgatagctaactcttattccagatatcaaaaaattaagaataaggaacaacaacaacaacaaaaaaccatttaattttgcttgatataattccttcttttaaaaacagaaataaaatattttcattctattctgtgctaataaagaaagatatttctgttaaaggacaaaatgctataaatattccagccactaag

SEQ ID NO: 394475 - DNA, 995 bp, Homo sapiens
ctttttgagcatatgcgggcagttcatttgaagtgtttgtgtagcacgtgcaatgcctgtgcttcctgaggaatgcattcagttgatttatttctttccttttagtgggtcttgctttcttttatgtttgtctgctttgtaaacttttcttgagatctgggtattttggatgttatgatattgtcactctcgaaatcagattgtctctcttctctgccttggctgatgttgcttgctgaaaggtgctgttattcaattgcgtggtgacatttccaaaatattttggtaaggaccagcttccttgtcagagtgatccatgcagtttctgttcaattatttccatggccagaaattgacctgacagagattattttatgtctctctcttcatcggcacatccctgaatactgcaaatgtgggacaagattctgttgttttatgagagttaatgtcatgactcttgccacttcaagtaatttcacaggagggaccatttgctggagcttcgtactccaccatcttccatgatgccactctgagagcaggtattcttgtcttttttgtgcaccaataaatctccatcacctaaacagtatatgagacagtttagtgaactggtttaaattcatatttgtttaatgtgtaagtaaatgtaattgaatttataatactttttatccatttcccatgagtcaggtgctgtgatagcaatgttttacgtatgcagttacctttcttttaattttcatattttattcaatgtgtatgtcttcaaatttgttcatggatgtcttagccagatttatgatttttaaaagccaaaatataatgtctcgctaaatctactgaaccagtggagggacatcatgtggtcacccactgctcccgtggcatccatgagtgtggctttaactctgcctttttttttttccttgattagtgttggaaaatcataggtgaccttttgtcaggagaataaagtattaagaaccatg

SEQ ID NO: 394476 - DNA, 642 bp, Homo sapiens
ttcttgcacaatggcgcaagtttggctagaggggagattctgtctttgtgcaaattattagagttccatcctaggaatccttatgatgtaataatatttaaatggcattagaagcattttatatattataggtactccaaaaaatcatcttacttggaaaatctaatgagagtttttgggtgctttatcagtgaccgtcatcatttagatgttctgtgttatctaatttgccttttataattattgatgttgtttctttctttctttttttttttttttttgagacagagtcttgctctgtagcccaggctggagtgcagtggtgcagtcttggctcactgcaagctccacgtcccgggatcacactattatattctcctgcctcagcctcctgagtagctgggactacaggtgcctgtcaccacacctggctaatttttttgtatttttagtagagacggggtttcaccgtgttagccaggatgttcttgatctcctgacttcgtgatctgcccgccttggcctcccaaagtgctgggattacagacatgagccaccgcacccggcttatgttgtttcttaaaatgaaaatatagtttttaaagcattatggagaatttaaccttccactggtctgatcaa

SEQ ID NO: 394477 - DNA, 492 bp, Homo sapiens
ctctagaggatacacctccataatgtgagcccagaccagagtgcaatagcacaatttcggctcactgcaacctccgcttcctaggttcaagtgattctcctgcctcagcctcctgagtagctgggactatagacgcccaccaccacacccagctaattttttgtatttttagtggaaacggggcttcaccatgttggccagatggtctcggatctcttgacctcgtgatccaccccccttggcttcccaaagtgctgggattacaggtataagccaccacgcccagcccatttaatgactttttaaattgagatattgtacttttcagttcagacattccatttttatagttttcatttctctgctgagcattcaccaatgtttgcattcttgaaaatataataatgtctctaaagttctttcttgccaaatctaacatttgggttatgctgacatctatttttattgactaatcttgattttgggacactt

SEQ ID NO: 394478 - DNA, 453 bp, Homo sapiens
ggattgtgtagatgtcttgagattatggtaatcatatcatcctttttatacttggggccatggtagaaaatgcagtttatagatgggtgagtctaatgatgcgaagagtcttacataaacataaaaactcaattctatttagttatatacttaacattttgtttttattggaaataataaaattatatggagttgagctattatactaaattttttgctatggaggctagagttttcacaacccttaagtgcagataagttagtgcttagatgtaaatgttaagaatcatggtactttgggaggaaatgttaatttggttgcatttatctgcagcgtcccatgcttttcttctgtttctctatctttccttctccatcttccaacatcctcacatgcacaagagcacaggtatgcacacacacacacgcacacgcattgccctgttggccacc

SEQ ID NO: 394479 - DNA, 628 bp, Homo sapiens
gagaaccccattttacacactggggataagtggcctagagatgaggcagccacggcacttggaataaatgctcccagccactcaagagggcagaattatcaggaatctgtggccctctgcagagagctttgggatcagacagcctcccactgaaacccagctgtcctcccccgagggggtgtggcccccaagctcatagctttgtgaggaccccacagcacattcagggagggctgcgaagtcagatggcaccagggtcctggccagtgaccgggcggccagatctattgcatccaaatagccagcttccactcggctacggcgatcgccagacatgggagtttggtgttgctagatctgatttgtccccctaagagaaacctggatttttaagtgaaatcgcctgatttttgaaaggttggctagcaatttaaattttgcaaaacactaacacctggggaccaccggttggcatccccctccttgtacaaagtggtgctcaggctgtagcgaagggcggaggggcttctgcttccccacccccctcctcctcctcctccattcttctgcccagagtcaccccctcattctggtcactcccgctccctccatccccgcctatcctgca

SEQ ID NO: 394480 - DNA, 247 bp, Homo sapiens
gtttccccactcccaaaggaaattcaaagtagacgaatggtcagaacccagaaattgatttaacatccagcttcaaaggggatgtccagggcaaactgtcttggtttgaaaatcaaaaccattctgcttttattaatgtcagaataaacataagtaatttaaatgtgacccactccagagattgataacttccttttttttttttttttaataaagtttcaggctgggcgcggtggctcacgcctgt

SEQ ID NO: 394481 - DNA, 371 bp, Homo sapiens
acaggctgcgcccagagctgcccaaacagggccagtaacctgggacctgggagatgggtgcagacaggcagatctcagtgctggggttcccccaaccttcagtattttttccaactccctacccacagcctaagtcctcatttctgaggccagaccctgagctcgcacaatgccttttgcatgtgtctagtgccacacttacctgctggtaggagccaatgccatttgttcagtttcagtctctaaggcctaacatcctaggagttggataagtattcatgttaacttcctccctcttccattacccctcacttgcgcctgcttcccaacaccgtatccctttgcgtgtaacctcctattatccctctggt

SEQ ID NO: 394482 - DNA, 462 bp, Homo sapiens
acaggctgcgcccagagctgcccaaacagggccagtaacctgggacctgggagatgggtgcagacaggcagatctcagtgctggggttcccccaaccttcagtattttttccaactccctacccacagcctaagtcctcatttctgaggccagaccctgagctcgcacaatgccttttgcatgtgtctagtgccacacttacctgctggtaggagccaatgccatttgttcagtttcagtctctaaggcctaacatcctaggagttggataagtattcatgttaacttcctccctcttccattacccctcactaccttatcaaatgagtcatccaagtcctcagaattctgccttcataaggaagaaggactcttcccgttgcccccggaattgcccttctgccagccgtgttcctgcatggctggactaatgaacagcatagctctcacctggagtcactg

SEQ ID NO: 394483 - DNA, 768 bp, Homo sapiens
tcggccttatatataattatatatgtaaatatgtaggatgtttgcacgctggagaacttattagccctctcgtgttggaagctagaagttttccttctttttactttccaattttctggagcaatagaaaaataattgggataatttgttctttaaaagtttgataaagtttgatagaacccccactttgtaaccatctcagtgtgttgctttttgtggtggatacttttttggcaactttacttttttcctcttttcttttttctttatttattgatagaagaatttaatgatgagactttttctctgggcacagctttagcaacatcatgtacgttccgatgtgttgtgttttaattgtcatgggggaaggtttttagtaacaaaatcaggttttttaatagagaaccggattttcaggttttttgtttctattgatgtcagttttcacaagttttattttctaagaaatgtgttcatttcaggctggacatggtggttcatgcctgtaatcacagcactatggggaggccgaggtgggcagatcacttgatgttaggaattggagaccagtctggccaacatggtgaaatcccatttctactaaaaatataaaaaaattagccaggtgtggttgtgggcacctgtaaccccagctacttgggacgctgagggaggagaattgttggaacctgggaggtggaggttgcggtaagccgagatcatgccactccattctagcctgggtgacagagagactccctctcg

SEQ ID NO: 394484 - DNA, 369 bp, Homo sapiens
agtacctaccttacgttgatgtaaagaatcaattaataatgtatgtaaaatgtgtaaaaccacacatagatcaataatgtcaactattactgttattatggttcaataaatatttgacagttggtcacacagtgtgttggcttcctggactcttcttcccccttaactttcctaaaaagccaagctattgaagtcattatctttttttgtttcttaaatcacatttgagttcatatggtgagccttggcagagcccccaaaaataatgaaacgaaaggaaacatgtctaaacaggtctacaatttggcatagcactggtttggtacaaacctatgcagcctagggaaatggagaatataatatctccag

SEQ ID NO: 394485 - DNA, 459 bp, Homo sapiens
cccttcttctgaggacgtaagattaaaaaaaaaaagtgtctacatgatgagataccacgacagatctgataactgtgactgacgggcaggcagtgtctacagtgtggatcagctgaccacatcctgggcaggatggggcaggagggtgagagagttcaccacacttctcagaacagcacacaattcaaaacttatgtattattatttctaaaattttctacttaatattttcagatctcagttgaccatgggtaactgaaaccacgagaagcaaaaactgaggctaacaggagaccgctgtaaaatatctgcagccactaagattggcagggagcttttaactggagacaaaagttcattcacagaaatcagttcattcatcttcagcctcatctcattcattaaggactcaacacaccaaacaatactctaggcaccagagacatcaaaacaaagaca

SEQ ID NO: 394486 - DNA, 446 bp, Homo sapiens
atgaatggacagatggatgcatggatgaatggatggttaggtggattgatggatggatggatggatggatggatggacaggtggatgcatggattgatacatggatgacggatggatggacggacagtagatacatgatggatggatggtggacagatggatggatggatggacaggtgcatgtatgaatggatggatgggtgaatggacaggtggatgcatggatggcatggagggatggttgaatggatggatggatggatgaatggatggatagatggatggactggagggatggttgaatggatggactggatggatgaatggctggatggatggacaggtggatgtatggattgatgcatggatggatggatggacaggtagaatgcatgatggaaggatggtggacagatggatggatggatggacaggtgcatgcatga

SEQ ID NO: 394487 - DNA, 301 bp, Homo sapiens
ctccctcaagtctggttatttaaaaatgtgtagcacttttcactttgctctctctttcctgccaccatgtgaagacatgcttgctttccctttgccttccatcatgattgtaagttttctgaggcctcccaatcatgcttcctgtataacctgcagaactgtgggtcatttaaaccttttttcttcataaattaccaagtcttaggtagttctttatagcagtttgagaacagaataatataaatgccaagctttttcagatcaaaacaggttaactagctataaggcttagggcatgcac

SEQ ID NO: 394488 - DNA, 125 bp, Homo sapiens
aatgtatatatgtaaacatgtaattatgacaataatatttacatctgcagacttagacatgtgcaagagatttgttaggaaatacacttaggaataccattgcaggatcttggtgtacgtactta

SEQ ID NO: 394489 - DNA, 505 bp, Homo sapiens
gttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttataagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgcttctttcacattgttcctgatagggcaccattcccaaac

SEQ ID NO: 394490 - DNA, 234 bp, Homo sapiens
acagtgtgtttctttcataacggttgcaagaaaatactgatcagtggattgaattctgtgtttcatccagcaaatttagtgattttggaatctggttaaaagcaagtgacctgttcttaaagcaaagtagcatgtttgcatcacttctatgaatgcagtattcattgccatatttgagacaataagcattcgaacagccagtgttaaactctgcctgaaatgcccttgggaagt

SEQ ID NO: 394491 - DNA, 163 bp, Homo sapiens
tacatagtctggaaatcagaatttggagctttaaactttaacatgggtaggatgccaactatgctttaaagttattttctttgatgcagaaagacataatttttagtatatcataacattaattcacaccattaatctttttttctctgcatattgaatcata

SEQ ID NO: 394492 - DNA, 232 bp, Homo sapiens
tcctcctctcctactgtatctaggttaagagagagtactctttttaacctaggaaccactttaagattttagaaataagaatatgtttctacagacctgaacattagtggttttttttttttttttttttttgggaaaaaaattttggttttggtggccggggtgggggggaaggggaagaatctgggttcacaatgacctcggcttccagggtccaagcaatttccgctgc

SEQ ID NO: 394493 - DNA, 320 bp, Homo sapiens
tgcagtcctcagctctggccccaatagactgtccatttgtattgattttgcctaagtttcttccttttagatcaacaaacttatggagcgcctttctgtttcatagatgggatgcttcttgattcgtgactcgctaatacatagccaattagatcactgaactcttgttgaaatattttctttctttttgagactgagtcttgctctgtggccaggctggagtgcagggcgtgatttcagctcactgcaacctccacctcctgggttcaagcgattctcctgcctcagcctctggagtagctgggacttcaagcatgtgc

SEQ ID NO: 394494 - DNA, 445 bp, Homo sapiens
tctctcccttcagatctcagctcaggtgttacttcaagggaagccttccctgactctctagttagaacacatgttccttccattcccttgggttgcacacatagaggggatcttgtggctaacataagctccacaggagcagaggccaggtctatttttgctcactgaagcagcctagtacttggcacagagcagaaactctgtaaatatttgttgaatatttgaatgaaagaaaggaaggaaggaacaagaattaatagaaacaagtttaaatggggtgttctataaacgtgtgcatgggaacagaagtggggaggagaacagaagcctattaaacattgaaaacactgcaggagtatttagcctaaccttcatctagatgacagacacaaagtttagtttgtttactaaaatactgaaataagggagtagggcaggtaatgct

SEQ ID NO: 394495 - DNA, 530 bp, Homo sapiens
ccagctccacacagtcagtccagggccacggacgcagaagacagaggagaagaagctcatggcataaagacagaggattgattgcccaggaggcttccaggggctttggctcctggggcttcttgtcagcgctgggtcagagcaggtcacccttgtgtgcagacactaggttgctgcacacagcggtgaagaatgggggagaccagatggaattgggtgaggcagggatgctccttggtgtttagagttttcctctttctttgccttgtgggttctctgtagcccatctttgctttttgtaacactagttttcagtaattccgacctttccgaatacctctatgtacatatacctgtctactctcctttcagatacctgtaaagcctacagaaaggtaatcctgcagattatcactctattcagcttaacagatgctcgtcgagtgctgctgtgtgtgtgggcctcaggttcaggtgcacctgcctttgtgggaagagcacagcttccctgcataactgctggagggtgg

SEQ ID NO: 394496 - DNA, 199 bp, Homo sapiens
gggactccgggaccttgatgtaagcaggctggtcgctgagcaacaatgaaggcctttctctgccagggctggtgcgtcaccatctgggggggtgcccagggtacccccatgccagcctctttgtccggacacaggcatggctgggggaccagggatggtccagctctgtgctggccgccggcagggagggagcctggag

SEQ ID NO: 394497 - DNA, 302 bp, Homo sapiens
tagagcacaagtccattcacagtgaaggtagggtccaataaagggtcaaatactgcccacattccctgtttttccattttcctttattgtttaccattctatttttattttacatttagacagctgctaggttctaagatactaactagatacattcttaagttttgagagcatatttaaaaggcacagttgccacagatatagtattttacatactgtagaattttaacagacatttctgcctagaacatattttgttttttaaacatacaacacacaattttgagggcaaaatatacatg

SEQ ID NO: 394498 - DNA, 500 bp, Homo sapiens
aatctaactaatgcctgatggtctgaggtggaacggtttcatcccgaaaccatccccccaccacacctcatctgtggaaaaattgtcttccacaaaaccagtccctggtgcccaaaatgttaaaagaccactgcatatatgtatatatacattcatacagtattattacagggattttatatccatctaagtggattagatttattttgaagaatctattcatggtatctaaaaggtagagatttcaaagttaatttattaacaaggtacatgaaacagttattgttcaaggaatatttttaaaagatgaatccatgcacaatcttgtttctcaaattatttatatattcatgtaaaagccttttaatgaaaataacttccaatatttaaaaaagttggttttgatcccatagccagaaagttgctgctatttatgaaaatcaccactctttgtatagtctctagttgaaaatgctaaataaaataaattctatttccaa

SEQ ID NO: 394499 - DNA, 399 bp, Homo sapiens
caggccccgagcccatggcgctgcagagccggggcaaggggacgcctcgcctcaggctgctgtggacactggacgacatcccacgccgccgcctctgccagagaggcctcccagctgagggcaccaggcaggtgcccagacctgggctgtggcttccagacgagccttacaacagcctgtccaaggacccctgatcccggggaagatgttccagggggccaggccacagggtccagagcccagcagtgacagcgcctcctatgttgccagcagtgccggaatcaaaactgatctgacctcactcacaggggcctggagctactatgattcacttcctcgcagctttctgctattttttttggttccaaaaggtttggtgcccccttgccacccagggca

SEQ ID NO: 394500 - DNA, 323 bp, Homo sapiens
aagatataggatcttgctctgtcacacagactagagtgcagtggcataatcatagctcactgcagccttgaactcctgtgctcaagcagtcctcctgccttgggctcccaaagtgctagaattagaggcacaaaccaccacgcctggccaagcaagcatatttcagagatgatgaaccgagagaaaaacaaaaatcataaggtgtaatttattgttcttacatgtcaatatttgaggtgtgctttaaattaaacattttaaagatgtaagatctgaaaggggagcagacattagcgaagtcaacgatccccacgccatctcat

SEQ ID NO: 394501 - DNA, 268 bp, Homo sapiens
taacagacatctcacaaccaggacatcccagaagaacactcttaatctccacttccttgtctcactgacgagccccagcaccaacgcagtagctgaggccacaaaatttctcctttcctttaccccctacatccaatcccatgaattgacagctccacctctgaaatacatccacttctcactccctccacccccaccgtcatttcttaccaagatcaccagttatcgcaacagactcttaactggtctctctgcttcccctgactgc

SEQ ID NO: 394502 - DNA, 281 bp, Homo sapiens
tctctgctataacactcccatatagctctcccttctaggcattacatgctcttaaagaataatttcccctggagcgggttgaagtggacagtgctgagcccaggattcccagggtcagcttatggaagaggagccaactcctactttacaagcctctgagcaactgcactcaaacgttcaaattcccagagagctgtaatcatcagcagagtcaccagctagtcagtggcagaggtgggattagaacccaggtctgcttactggagggtggcctctacctc

SEQ ID NO: 394503 - DNA, 346 bp, Homo sapiens
agttaaaatttatttagttaaaacatgatacatattttggctgatttattaaaaatcaaattcctggctgggcacagtggctcacgcctgtaatcccagcattttgggaggccgaggcaggtggatcatttgaggtcaggagtttgagaccagcctggctaacatagtgaaacgctgtctctactaaaaatacaaaagttaaccaggcatggtggcgcatgcctgtaatcccagctactggggaggctgaggcatgagaatcgcttgaacccaggagccggaggttgcagttagccgagatcatgagatcatgccactgaacttcagcctgggtgacagagcaaga

SEQ ID NO: 394504 - DNA, 221 bp, Homo sapiens
ctgcagaaggtgaggacggaagcacagagagggggcgacggtaatggtccaggcaggagacatggtgacagcggaggggacaaggcgcagtcaaattctggacataatagcagagcaagagggtttgcagatggattggccaaggagtgtaagggaacagcagagccaagagccctccagcatttgagaaggccgggtgggccaggcagatggtgtcaaga

SEQ ID NO: 394505 - DNA, 608 bp, Homo sapiens
tgctactggaaagtccgctcagcacgctgaagtgtaattgtgaagcaaaaattaaattctcagccttcagccaactgatggaccccctctctcagcctcaggcgttgctcagtcaacctgaaaatgtagttcaggccatggttagggaggtcaggcaggcctcattgggcccctccctttggaactgaggcccagctgaccagcattcacattaaacagactctgacaaaggcggactttttatagcagcgacagcacaccacattccagcctgactctagtgtagcatcacatgacaggtggcaggccctgaaagaaatccgagtattttaccccaaaatagatttctttgacatttttcagaatggctctacaggactgtgtcttgtggggaaagtctgcaccctgtagagaatctcctcccttcccaggtcttttccctggtgcaggagggaattaactcggagtctggcaccttgtgaggtctgctgcctgctgcctggaggcctcatctgcttgataaagccttggtctccacagccccttatcttaagccgaggcattcctttctattgattccaagtctttagataataactctttcaaac

SEQ ID NO: 394506 - DNA, 740 bp, Homo sapiens
aactatggattgagtgatattcctgaactaacatagaagagtaatatttagtatgaaaatatgtggttgaaaatatttagtatgaaaatatgacgtgtactacttctatagatattcattgaaaaatataacacataatatttgtgttatattttgaaaaatataacacagaaaaatacaacacacaaaagaaacacagtttcatccatgtccctacaaaggacatgaactcatcattttttatggctgcatagtattccatggtaatatgtgccacattttcttaatccagtctattgttgttggacatttgggttggttccaagtctttatgtaacaaacctgcacattgtgcacatgtaccctaaaacttaaagtataataataataaaatttaaaaaaaaacacaaaaaatataacacaaaagaaaaacacataatattcattgaaaaatataacacataatattcattgaaaaatataacacataatatttactgtatatgtgacatactttagcaagacttgatatgactgttaggtcaaactggaattcacagcccttggaagcgttcattctgctgatgtgtatgtgtgtaagcacttaaatgtaattcttatgatatagacctaggtgcatggatacatagatcaagtgaggatgatgacagccacatcttaaaggaacttgacatagagacagataatatgtggtgaagatgccatgtaatactggctca

SEQ ID NO: 394507 - DNA, 464 bp, Homo sapiens
aagcagttatacagactcagtgagatacaatgtgactcccttagttaccacctctgtgggggcaggcctaggtgggaggaaaaccttgcacccttcatattgctgttcagttttggtgggcatctaccaagggaaccactctggaggaagactctctgtctgatgaaatacaggggacaggccaggtgcttactagatgagtagtatctacttatataatttctgaaattttgaaacatcctgaactttttacaaactaaataaggagccagaagtaagtgatatgtaagttccaagaaaattaaacaactagcttctaaatatacctcaaaaagtaatgtggtttctcaaggcttgtgctttgcagtgggcaaatctgatttatatatttatcaaagaccataatggatattacattccttttctgtaagcagttgatactcaatgagatacaatgtggactc

SEQ ID NO: 394508 - DNA, 645 bp, Homo sapiens
acagatatggtgaaagttgcatgacattgtgaatgtacaaaatgccactgaattttacactttaaaatgattgatgaattttgttatgtgaatgttattacaactttatgtatttgagtatatgtcatttattaatggacaaagatacattctgtaatttgtctacctccctcttgatctgaaaaaactacaaagcatgtctcaattctaatgcaaagtcttaaccaaaatgattttttctgagctattcatatttagcttctggtgactcacaggaacctgaattttatgttccattcaacactccattatgctcttaaatgagaatctaataattttcccttggaatatttttgaaatccaattctaagtatttagaattttagacacagtcgtatctctcgtttgaatattccaaatattgaactttgttcaacattgtttcaatttgcaatatttatgggttgtcaaaacaaaagtagagatttttttctttatgtccgtgtctaaaaatgtcattttggaaatggcaataaaatagagcattaaactgaaattaatatcatgatgttgaaggtgtgacctaattaaaatgcaaatgtaagcacacttctttaaaattgacattgcagcttatatattccc

SEQ ID NO: 394509 - DNA, 274 bp, Homo sapiens
cacatcagcacgtcttcaggacgcatgcacctgtggccagccccaaatgagaccacatctgcccttcaggtgttcaccacctaactgggggacaagacgattattcagggaaccagatgttatgatcaggagcttttacgatcaggtgctaaatcagagtagcctggaggcactgaggcaccggcagcatgggcaagatcagccaggaagtgatcgcaggacaagtggggttcgaaaggtcgcaggacatggagacttgagggcttccagtggg

SEQ ID NO: 394510 - DNA, 444 bp, Homo sapiens
ctatgtcaagagttaattttcacttatagcccataaagccataaaaagtctactaatccatgttctagacagaaagtaacagacagtaatgattatgtaacaatccgaagaaaatgcagaactccttccttagcagagagtgattcatcaaaatagcttttctccctaaaaaaaaaaaaattcaaaaacaggggctgtgcaattggaattaaaggccctaaagctgctgctcctccatggtcaaggttgcaacacatttgaataactctgaaggagcctctgtcataataaaaaatatgtgattaattagatccgtgttttttacttaaaattaaatacatgattccacataggaaaataaaatacaggtgactcttgaaaacatgcatttgaacaactgcaagggttcacttatacagaatttttgtcctcctctgcatctcc

SEQ ID NO: 394511 - DNA, 686 bp, Homo sapiens
cctggcatctcactaagggcaggggactaaggtcatgataatgtggaggaggctttctctaggctgggaaagtagtcctaggggagcacagactactttgttgactgaaggggactttgttcaatgaagagttacagtgtatactctgggaattggtggtgggtagaggagacacaaaagtggaagctggtgttacaaacccgacataaactgctgctctcaagttggtctggcatcggctctccatagaattcttttgaattcatccttccctgtaacttcttgtccctgactctgccctcaaatctccaggcaaatccttgcctttcaatgtggtttggatagcaatgggcactgagttcatctatccattcatgtactgatttgtggagattcattcagtaccagctatgtgcctggtactgtgttcatcactgagataacaggaatgaaagatcccgttgagtggatgatccagcttcctggtatcaggttgaggggactgggagaagcagaagggatggagagtcggacgaagagaaaagcgttcttagtcaagaggaagcgagtctgctgtaacccaacctgcagaccctgcatgcgtgaacatggtgtgatcagcctgtgaacattcataaacactgagagctgcgttacacagtgtcactggttcaccagaacctctg

SEQ ID NO: 394512 - DNA, 318 bp, Homo sapiens
ctgtaatcccagctactcaggaggctgaggcaggagaatcgcttgaaccggggaggcaaaggttacagtgagctgagatggtgccattgcactccagcctgggtgacaagaatgaaactctgtctcaaaaaaaccaaaaaacaaacaaaaaaaaatcatgcaacagaatgttagaattggaagagagtgaaaagtaatttagtttaacccagaaagcagtgttatttcccacatacttcaaagaacagacttttaagtattcttttaaaagtcagaaatgccagccaggtgcggtggctcatgcctgtaatcccagca

SEQ ID NO: 394513 - DNA, 149 bp, Homo sapiens
gtatattgtgggtgtgtctgtacaggcatatgtgtgcccatgtgtgcatattatgggtgtgtctgcacatgcatgtgtgtgcccgtgcatgtatattatgggtgtgcctgtatatgcatgtgtgtgcctgtgtgtgcacattatgggtg

SEQ ID NO: 394514 - DNA, 244 bp, Homo sapiens
cttagactaaagcatatttgaggtgagaattacacatttttagtagtttgtaagatccatgaaaaaaattatctgtatttattactctctgtcaccctgtttcatcttgttttccaccatccataattccacttagcttaattcatttccctgtgccttaggcataatcaatagttgaattgcatatttctgctccagaactctgctcttataatgatattttaaaaatatattagaacaaagt

SEQ ID NO: 394515 - DNA, 468 bp, Homo sapiens
aattcaataaccagttagagtggatgcccaaccaataagaactgatggcatactgctgggaagtaactgattatatagcttagtgctactcaaagtatggtccatggactgatgccagtgtacagttgaattataactggcctatgaagagctagatagagaagttgagagtatttagaaactttatggcaaaatggcattgctatgacatccaagtaggtgaccaatgcaattatcttgtggaacagggtagtttgggtgtgtcactcttgtgtggtgagtcacatgtggtgtgagctatgtataagccatccaccataggactacatactggtcttgacagattggaaataaaaccccggtccttcaccacagatagtttgagaagcagtaatctgtttatctctcttaacgacctatctaatgtgtctgtcatccatctcttaatcaattcatctatttacttac

SEQ ID NO: 394516 - DNA, 297 bp, Homo sapiens
gagatacctgtgaaggagacaaaaagtggtcagagagataggaaagtcaaccaagagagaattgcaccttaaaagttaaagctagtgaggatttcagaaagtaagaacagttagttggtctgtaatgtcagaatagttcgggatagatcaatttgtacactgagaagtctcctttattttggcaatcaggagatcttagagcatttatggcagttccagaaacctcaatactatatattaaggagtgagtacaagagaaagaaatgtagactaccagtattatgtcactagaagatt

SEQ ID NO: 394517 - DNA, 138 bp, Homo sapiens
cacagagaataccccaccaaccttggtactattaactctgcaatgtttcagaacctccttagtcctgtgaggaatgcaggaagatacatcacactgaaattagtgggatactaaaagtctgggattacgcccaggaac

SEQ ID NO: 394518 - DNA, 111 bp, Homo sapiens
tgtgacagagcaaaagtctgtctcaaaaaatacctagataaatggagagatagactacatttatggattagaagtctcaatgctgttgttatgtcaatctcctaaatccat

SEQ ID NO: 394519 - DNA, 196 bp, Homo sapiens
gtcgttagcactctacgatgttagctaactgaaaaaagtgttgtcaccgagtcatccttcaacaaccttatctctaactaccctctcttcatagtctacttcagatagacaaacttaattatctcatttctctgaaagtgccatgctatttcatggcttcacacattttttttttttttttttttttttttttttt

SEQ ID NO: 394520 - DNA, 280 bp, Homo sapiens
gctttgggttcaaatgtcagctctgctgttcactgcttgggtgactatgtcagggtgcttttggctgtaagtaaatgaatacctgactgaacatggtgccaaaccttgcaaagcaggagaggtgggtaggctttcctcagtagccccattgcttatcagggaggagaagctctctcagaaggcccccagctaactttccctaacatctgattgtttgaaaatccggacacttggctactcctacctgaaaaggaggcagagaatgtagatcctagtattt

SEQ ID NO: 394521 - DNA, 621 bp, Homo sapiens
gcctgcatccccaccgtcccttcatgtccaggtgcggtgtctccgtcccagagaaactgcatggagtccccccacggttcccactggagccagacctcagactcggagctcctcagtctctgctgggtcagaggcagtgcgttcattttaggagcaaagttgaattcaaatttggatgagcacacgaggcccctggtggagctattccttctgcctttgaaagttctgttgagaagttgcacataatgacgttagcagtcttcgctaggcataggatgttttaatgaatagtcttccgtttccagtcatctcttactttaaaacatgtctctattatagaactaaaaaatgcccatcatagagggaaatattggaatacaatgaaataaagaagaaaattcaaataaataatccataacttggttatccagaggcaactcctgttaatttttttggatatatttcattcctaaagttctatctttttaagattgtcatgtagggaacacaggaatcacatcccgtgcccccttcctttcttaaaatagcatagttgatgccttattaaaatctttttttattatagtaagtaataaatttcagccagattgcatgtgtgga

SEQ ID NO: 394522 - DNA, 388 bp, Homo sapiens
attgcagtaagcctcccacccctcttatccccaagttatgacaacccccatcctagaacccctggtgcagtccgtctggcatgccatatttgcctagctgtttaactctttgtaggtattcattgatctgatggggttaggtgggcagagcctgttccatgccccttctttaggcacaaaatcagtgcctaaagtgacatttcaaccagccttctagacaactctaatggcaggtatcagatctcgagatgagcttcaccatttcaccttgggttccttcaagactcataggttccatttagagccagaaggaatcttcactcatatacacatgcatatgtgtacaatacatatgcatatgtatatttatatgatgaggaccagtaat

SEQ ID NO: 394523 - DNA, 295 bp, Homo sapiens
gcacagcttacttgttgtatcccattcaggaataagcaataaaccaaaaatatgtaagtgaggaatagggggagaattgcaggcttatttcactcttgcatgtacacatacacaaaaaagttcccactttgttgggtgtttctagtaggttatcatctgcatgatgaaggctcaaggcagcaggaatgatagggcacttagcacaacaatcagattagaaaagaacagtttagaccctaaacaactgaccacttcatgaagcttaaagaatccaaaggaaaaaatttagaaatta

SEQ ID NO: 394524 - DNA, 440 bp, Homo sapiens
agtagctgggattacaggcacgtgccaccacgcccagctaatttttgtattttttagtagagatggggtttcaccatgttggccaggctggtctcgaactcccaacctcaggtgatctacctgcctcggcctcccaaagtgctgggattacaggtgtgagccactgtgcccggtcaacatctttagatagttacaggagactcttctcctccataaaggggagaggaccccgaggcaggggaaggatgagctggaagtcacccagtaggaatgtggccccaaagccttgtgcactgggcttcctagagcccagataggggtgatgatgccatgggtgggggcatggggcccacaatggcaacatctcaccactggttctccaggagcccagctgcctggtagctctcagctgttgcagatgcaacccagcttcccattcg

SEQ ID NO: 394525 - DNA, 349 bp, Homo sapiens
aatgggcacaccgctaatattgggtctgacctgctaacaaataatacattaagctaatacaaatttgatttctgactgtttttgctctaagaattgtttataagtactgaaataaacaaaaaagggcaacaggaggaattaattcattttctaaacaagaggaatgaaccaaggacttgtacagtccacaaatttgtccttgattattgtgaggtagtagaaaggagcctggattaggagtcaagagactggggtgggggcgccagttgaatcactaaggactttgtacagctactggtatgtcattctctttgagtcctagtttcctcataactgtcctacctgtccc

SEQ ID NO: 394526 - DNA, 167 bp, Homo sapiens
taaagcataatatccaataataataagagtattgtgaatttggcattcatattgcttggtaatatgataaattagcatctgttgttgaaagtaattggatacctgatacactgctggtgggaatgtaaaatggtgcagccaccatggaaaacagtatggcagctcct

SEQ ID NO: 394527 - DNA, 212 bp, Homo sapiens
gatgttcacagacacagagtttcatgaagctgtggtgtccagaaaacctgctgcacatagggtgcacaatgagtttccatcttcttgcctctttttaaggggcgagaactcagtccgggagtgtcttaaactacagaccttcatgggaaaccttctcctccatcctctcctctctcttaactcttcatccttcccctctcccttaacccgag

SEQ ID NO: 394528 - DNA, 395 bp, Homo sapiens
taacatacttacatgagtgcttgacataaagtacgtgttttcgatgatgataaagggcagtcagactgttacctgttggtgaattaatttggaaatagtataggaaagcattgttgtgattaatttgtaagtcatttgggaaatgaatgtttgcttctaatgcatatgcagtataatgcctttattttaaaactaatagtgggataagttatataaatagctcacattatttcaatactacatttaatatccaaaaagtaccctaaaaaagtgtttaaaggtattgaactcttgttaggcccaggtgactgttttgaatacctttaatgcttcagtttgggtagctataaagttgcagagtgtttgttactcttaataagatggaaaatcatcta

SEQ ID NO: 394529 - DNA, 460 bp, Homo sapiens
cagcatctggctccctgctgctgccacttactgattactaatgctgtctgctttcctccctcccacctgactcagaaggtccacgaggtgtggtcttccctctgagtccatgcctgtccagtcaacgtaatctgacagagggagggtcaggttgcctcagccaacagcttctcaaatgacggtcctccttgcctgagtcacacttcagcttcccaagggtggccaagagagctgggagcatcctcccgaactctgggctgggatagaatggccattactctcaggccctggagctgccccctaaacacacacacacacacacacacacacacacacaccacaaaggctgctgggaacccacctgagctccttaagcccactctcgaacataggcacctcatattcttgggcagaaatgtggctttgttccacacatccacactggtcaggcagcccgtgg

SEQ ID NO: 394530 - DNA, 409 bp, Homo sapiens
ctgaagacaatgctgagtatgtgtaactcctcagtaaattttagccatcttcatcatcatcttcatcctcctcctcatgatcatcgtcatcattctgaatcctattctttggagggggctgagaatggacaaatttttgaatttcttttcttttgtatgaaaacacttactctctgggtctttaacctaaacctgtcagacaagtccgtggacactagaaagtgaaaccagagggtgagagcttcccctccctgcctgctattgccagtgtggcctggactgccagctggaaatggcgggggtgtggcaggggctgggatcccctctccatgacatgtttcccaggtagacagggctctgctcccaggtggccagagcacgggtcacgcaggccaagatgatggaagca

SEQ ID NO: 394531 - DNA, 397 bp, Homo sapiens
ctttaaaggatccccggtgggtcgttctcgcagggggtgctggaggtggatttagctttcccccaccggccccttacagagaagatgatggtgtactcagaaacacggatgggaacacaggcctgccttgtgctcaggtggatgttcatctctgggtccgctgggacatctctctgctggcctgcgtggctgtacatttagagatataaccctgtgtgccctttctaataaaatgtaaataccaactgctctgagttgagagagagagaaagggatcagtatgaaggaggatggagggaaatcccacccactgaaggttaaatagaacatgaagggccagcaatgggggaagacaggtgctgtgtccatctcccatccttgctcagttcagcgcgct

SEQ ID NO: 394532 - DNA, 149 bp, Homo sapiens
gacaagcacacatgttcacacacagacgagcgacacacggacacgcacacacaaacacaagcaacacgcggacatgcacacacacagagcaacatgcggacatgcacacacacacagagcaacatgaggacatgcacacacacagagca

SEQ ID NO: 394533 - DNA, 2006 bp, Homo sapiens
  misc_feature (1074)..(1074): n is a, c, g, or t
  misc_feature (1603)..(1603): n is a, c, g, or t
catttttaaaccatcagatcgcatgatggcttgatctcactcaccatcacaagaacagcatgggggaaatccacccccacaatccagtcacctcccaccaggtccctccgtcaacaccgtgtggattataattccagatgagatgtgggtggggacacagagccaaatcatatcaggatgttttctgttttgtttacctgagacaaagtgctgttcacctctcctctcccacataatcaggggctccctcctgcggctccggtagcttttcctcactttcctttcagccctcgggacaccttccttggctcctttcagagctcagttactacttgggcccaatgtcaatgccaccttctagattctttccggcagcacctcctctggtcgcacatttctcttccagttattggagctgtcaaaaaagctccccagtgatggacgatagcgatttcactgtgctcacagactggtcaggaaaccaaacagctgccacagtgaatgtgttgatagcagcggggcagcagtagcactcgctcacaggcctggtggttggtgctggcccccaccctgaatacctacatgtggcttctccatgtggcctgtgcatcctcactgaagctcagcctgtctctccaaattggtctttccactcacctgttccccaaacctgcccagaccttcctgctgtaggcttttcccttcacttggcacactctttcccttgtcttcccatggccccatctaagccccactgtcagctgaagtgttatattctttgaggggccacctgaagccaccttgcaatgagggcctccgttttctacctcagctcaccatttgttcacagcacttgtcactgtggcgagttacttgtctatggcctgttgtcgttctcctgcctagacccagtgggctgagtgggggcaagtgttggcttttatgtccagttttgatcttggtgccagcacattgcctgggtggaagcatgtcctactatcggttacagggatgtcattctgcccagtgctcaggggcatacacttggatcccagttgtgtgcccttggacacnttgcttaacctctctgtgcatcagttgggtgataatatctactcctggcacattttcagcgttggctgagttacatgtacagtgcttaggccacctgggggagagtaagagtgggatacgtgaggatgtggagtctgttgcatttctgtctgctgctggcatccttcttgtcttgttttgagttgctcgcctctgtctgctccctagggcgtagatttgaggaatattcctggttcttcccaggcagcaggggctcaggctgtgctggagtcagctaggctaaggggctggtctggcatccgcgttgtcctgtcacctccttggtgttttctccaggcctggatctgtgctgtgtgggcacctgtattcctccctcctgccctcactgattctccatacctttcttctcgagagtgccaagcccctcccatgtgttcttgttcatacctaggatcccgggaaggggctggggaagacggtgcccaggtgccctgggtaaacaaagccacctgactccacgggaatggantgggtggaggggatctgaggtctgcattttgagtatctctggtctcagaggatgaagcatttggtgggggttgggggtggggggtagggtggaagaatctaaagtcttaaaagaaaatggcagttatttgtgggacagggctgtgttgagacttggcatgcttctttttaagagtcagtgttgtaatttaggtataagtgaagcagtactttgtattagtttcctgtaggcgctgtaacaaagcaccacaaactggttgacttaaaacaacagacatggccgggcacggtggctcacgactgtaatcccagcactttgggaggccgaggcgggcagatcacaaggtcaagagattgagaccatcctggctaacacggtgaaaccctgtctctactaaaaatac

SEQ ID NO: 394534 - DNA, 897 bp, Homo sapiens
aaagcccatggtataattatcagtcctaggctgaaggcctgggtacccaagggaggctgctggtataaggcctgcagtacaaagactggagagcctggagttctgatatccaagagtaggagcagagtgtcccacctctaggaaggatagggaggaaatcaccttttctctgccttttttgttctatctggggccctcagtcaattggatagtgcctacccacaatgaggatggatcttccccactcagtcctggttcacacaccatctcctctggaaacactctcacagacatacccagatgctttaccagttctctaggtattccttaatccaatgaagttgatacctaaaattaaccatcataaatagattgctcaaatttaactggtctaaacctaaagtcctgctctttctcttcaaacttatttctcccacggtcttctctatctcaaataatggatattccatccgtctagttcatcaagcaaactccttggagtctttatctacttattttctttctacctccctttcaatccagcagcaaattctgttggccttatcttcagaatatgtctagaatgtgatcacttctcaccgccttcactgccaccaagccaatatcatcttgatttagatttttgaataggcttccttctggtctttctgcattcacctttctcccttaacagtctatcatccacactgcagccagagtgatccttttgaaagataagtcagatcatctcttttcaaacctaaaggctttgcatctcatggtatagcccaaacccctataatgcctataaagctgtgcctgatctgctttcccattaccacctatttttcttccttctgtcccttaccccactagccatactgtcccatacttgtt

SEQ ID NO: 394535 - DNA, 474 bp, Homo sapiens
tacagtctcagggacattacagtggcagaagggtaaccaaagggctttggaagtatggaagaaagggaggctggcagtgcttgttacttggtttcctttggttttatttagagaaaaaaaagccaattctgaagggtaggtagggtttaaatacaaaggaaaagaatcttctctttgggattcagtcacggtaactacatttaggttagggtaatctagaactagttgctatctggaactcgacttgtctgttgtccaccagacccaccttcacgtactaaaagtccattctcactagctgtgcatggtatccataatttagtcctgatacgttacagatgaggtgaacagctggcatcaagaaccaaaatgggtacggtcagcattaaaaaggtctagtagcagacagcagggtctcagataatggacttggacttaagagcaggaatctagtctccaaggaggttaggggaa

SEQ ID NO: 394536 - DNA, 354 bp, Homo sapiens
tcagatgtctgacattgtttctaggcattagttgctcttcaggggcatcctactcccacccctgcaccaagtgctaagggcacaaagtgagatagagcatcttccaccctgtgccaccctcggccacctgcaattgctcatggtctagttaagaagctgactggtcagattcagagccacacatgccaaggattgaagcccagatggggctggcgcatgggcccgggagcccatcccggagaggagacctctgagcttttaaatgcaaacgagaaagaccctttcatccaaggcagggctggacccttgagactcagggcctcacttcatcctccacacaaccctgtgaagcag

SEQ ID NO: 394537 - DNA, 407 bp, Homo sapiens
cactggccccatcctctttctctggcctctctttactaacagtgtgtgagaggtttctctcttgagtttcacagacataaaatatctccatacacttgggtgttttcagatgaggacaatcttctgtgaaagatgagaaggccaagtgttctggataagaacctaaaggcttggtggaaggtcagaggctgagaggaagaagctaagtacctaccgcccaggtgtgaatggagcccgagtatctcaggtcctgtgttaattggctctatccttctgccactgaggagtttagtttgaaaactaataggttttgtgggaaaaggatgagagctggtgatggctgctttttagaattttgcatgaagtaatgatatttctctgacttgtttatttccccaaccaaagac

SEQ ID NO: 394538 - DNA, 242 bp, Homo sapiens
ctgcaatgtattcataaatggaatgtgacacaccaggggacttcacagatctgaatcctgggacaaagatcctccagcagcatgcagagggactcttgacttggtggcccagaggaaggaaaggatatggtggaaactggacctaagcctgagttcctgctcattccagtccttctggtatgtaaaggtcccaggaggagggccatgtgttaatatatgaacaaggatgtggaggttcagag

SEQ ID NO: 394539 - DNA, 756 bp, Homo sapiens
gtttcctctggcttacctctactctctctctctctcattgtttctcactgttgctggttaatcgcttcaggagctaaggggggaaatggcgatggggataagggtggagataaacagaggttactacacttggcatgtggataccacccaagcagcctgtgcaggggttggaggctcaagcaaaatatttgatgggtctgaatgaaaatctgatgaaacagatgttacttgaagctgagtgactttctcagggtcaagcaaataagtaaatggaggagccagaattataccccagctcattgcttaccttctgactcagctctgaaaaactagctccacatttttaacgctgccaagagctcccttctctgtggattcatctaagacaacagatattaacactaggattgtgatggcagtggagtcagtaccaactgacccaagtattcctagcctgtggaatctttagactcacttaattcattcaacatatacttattaagtgcctactgtgtcatgaacttcagggatatgaaattctgcaagatagtctctgcttttcagtaccaggagccccagatattatacttaatgtttcaaatagtggattctgggttgcttgaaagtcagtaggcagcctttttgtcattaaatttcctttattgctctgatgcattttattttatagtgactctgactacttcagattgttcacaatattttaaaacttacgttattaagattgctcaattctgc

SEQ ID NO: 394540 - DNA, 626 bp, Homo sapiens
tcccttaccctgaccctaaccttccaaccgttgattcctgcagcaatcttccctaagggagacaccccggctgtaggctcacttcctctcccaagtcccattcctttcacaagagtcaaatccctacagtggattcctggaccgttttttctaaaagaagatcccagtcctctggcttgcccctcccgtcgtgactcccatatttgatgggtctgaatgaaaatctgatgaaacagatgttacttgaagctgagtgactttctcagggtcaagcaaataagtaaatggaggagccagaattataccccaggatccccatcacaaggaggggagggctaccatcccagctgcaaactctcattcaaggtttatgctgcagccagcagtgtccttggagtctagttcaaagctgaagagagtgaaccatggaactgggagccattggcggagaggctggcctgaaggaagggaagtgtttcagccagaatgtactgacgcacaaccaggaaaccacaagactgatcccatgccttgattacaaatatcactgactaatgtattcaatgaatctgactgccacgcctgtgaaattgtaattttctgatgggctcaaataactttccaaa

SEQ ID NO: 394541 - DNA, 944 bp, Homo sapiens
ccatgacctgaactccacgcagccgcaacaccggacgtgagtgctggggccaggcagaaagcccagagcagccctaagggccagggaaaggaacccacgccgatgcgcagggtcagtgaggcaatgccctgggtttaccctcttctccattcttttgtgaccctgatggcagtgggagtggtggctacaggaacccatcagagccaaacttggggccagaaagtccctcacagctcagtgcggctgtattgagggtgggaccacccccattagctttcctcccctgtcctcctgccacatagactccaacgcggcccagtcaagggcatgtcactgtctgaactgacagtgagtgagcccagcaaccaaacccagcgtggggagcttgggaagcacccacatggggtggctgtggatgccgggctcagctcacatgcagacacatgggtctaatgatcacaccatggacgtggggaactgcagaccagccttgggtcccagaccaaagaccagcagctctgaagacaggagtccacgcaggtgggagcagtgtgggcccaaccctcacaggaccaagtgcctgctaaccaaagacacccacgcaggtgggagcagtgtgggcctgaccatcccaggaccaagtgcctgctaaccaaagatactcatgcgggcaggaacaatgtgggcccaaccttcacaggaccaagtgcctgctaaccagacttcaacatttcccacaggattcaaacatgacccagatctcataaagtcatattcaaaatgtctagaatatagcccaaaattgcttgacacacgaagaaccacaacatttcaacttgcagctgggcaccgcggctcacacctgaaaccctagttccctgggaggccacggctgcagggagcaatcaccgggccgctgcactccagcctgggtgacagagacc

SEQ ID NO: 394542 - DNA, 306 bp, Homo sapiens
ccatgacctgaactccacgcagccgcaacaccggacgtgagtgctggggccaggcagaaagcccagagcagccctaagggccagggaaaggaacccacgccgatgcgcagggtcagtgaggcaatgccctgggtttaccctcttctccattcttttgtgaccctgatggcagtgggagtggtggctacaggaacccatcagagccaaacttggggccagaaagtccctcacagctcagtgcggctgtattgagggtgggaccaccccccttggactcgtcagagctgggactacgtcagacgggtg

SEQ ID NO: 394543 - DNA, 420 bp, Homo sapiens
ctcctttcccgcggtgccaggtccccgaggcccatcacgctgcagcctgtgtgacagcttcgttcctttcaaggccggagaacatgccttgtgtggatggaacacgtttgctttattcattcaccctctgatggacacgtgggtcgtctctaccttatttaatgtatttcgacaatttagtgacacattcagcagtttccaaggacagtcacagaagggagctgtctccttccctgtctcccacctttgagcaccgtccccaccctggccaggcagccaggggtctgtgtgggcctcgctccctccctccctccttccttccctcctgtcttcctttcttccgtccctccctctgtctctccgtccctccgtccttccttccgtccttccttccctcctgccttcctttcttccctccct

SEQ ID NO: 394544 - DNA, 678 bp, Homo sapiens
tagctctaagcgaaagacatgaggcctcagcctgaaatgaggttgttttgaggtcatctgatttctgactagaaggtgagcgatcgcctcgtcctgaaaccacttcagcccgcatggtaaatggcaaagccagcgagagggaggccttcatgtgtttccgtgtctgtgctgccccagttccttcctcttcaagattaaaaacattttaaagttgtaaaccaaaggtttgcaattttttttggtgatggcatgttcagaatcttggatccctaagttcaatatattggacatatttaggaactctggaaattatgttgttttcacatatctagtaacttactagatgaatcagtagatttcattaaagtatatctaataacagataattatgatgtacttctgggttgacatgcatgtctctcattatcagctatcagtattagtgtcatgctttggagacagttatcttttgaaggttttggggttcttatgaacctcatttttcccaggaagtttctgtaattcctcctatgcctattcttgtcttttctgtctgcttgcagtgtaagttatttagatcagaggcaattatttttcaggaagaaagaaatcatcaagtgacactcctaaaggcagtaaagacaaaatttcagtctggaaccggtctcagaatggcct

SEQ ID NO: 394545 - DNA, 418 bp, Homo sapiens
ccaactgcacagctgcaaagcgcgttctgactccatttttactttccctagagaaggaaggcacctaacaaatatttgtgaataaatgaatgattgaatgaatgctgacttctcttctagggaagcctctagaaatcattttgtccagtggttcccaaactatggtctgggaagctgtaggattccatggagccagttgggagtagtgggaggctgagtggatagggctctgagcctttcatccctgctccagtcagaataacttcagtgctgcctgtttcatgcactgggagattgaaaacaatttagcgagtctaactcctacagcagtggttctcaaactctgttgtgcgtcacagctctgagggagattctgacagttggtataggatgggcatcaggactctgattgtttacc

SEQ ID NO: 394546 - DNA, 393 bp, Homo sapiens
atactctagaccatccgctaataaatggctgtattgtactaccataaagtatggtttcaccatgttggccaggctggtctcgaactcctgacctcaagtgatctgcccaccttggcctcccaaagtgttgggattacaggtttgggccaccgcgcccagccctaatatatacagtataaactcgagtatttttgattggatgcatatataacaatgagtatattagtacttccttatatactaattgctaagtaaacacattccttgactttttttttgtttaaatatgtgtttcttttttagagcagttttaggttaacaacaaaattgagcagaaagtacagacagttcccatatgccctctatctctgtgctcacacagcctcccaccca

SEQ ID NO: 394547 - DNA, 369 bp, Homo sapiens
tcttcttacttctacactttcaacttaactaactactattgcaggtacctcagatacctgtttacacattgctacttctttgtgtctccatgtgctttgtttcctattccatttccaagaaccagaacactttggcatgcatgaggtactcaatacataattgctgtttaaaataacatatttcaccctgttcatggacccactcaagactgtaaaaacacacacttgtgaataattcctgagtgaattattcatacacagaggccaaaatctacactctagattaaggtctacagtatatctttggatgtagtattgcacttttaaaactatttggcattttcctctcctgccttgtggtgtaaacag

SEQ ID NO: 394548 - DNA, 403 bp, Homo sapiens
gttattagtgactatatttagctaccagcccactagccatatctaaggatgggcagtactacagaccctgcatagagctgcatcggcaaacactgatgtagtgaataaacaaaacaaaacaaactcctgggctcctcaagaagctcagggcagccttgccagggtctctgctcttgaacaggtgcacaaaggttctaaggcctgacatgcctgcactggctgtgtgaccctgagcaagttacttaacttctctgagcccttctataaaatggggctaaatcctagcaacactgcaggatttctgtaaacctcagtctcctaatctctactatggggttaaaattccctacgttgtaggatttggtaggcattaaatgagataatgcatgtaacacatagcaca

SEQ ID NO: 394549 - DNA, 260 bp, Homo sapiens
agaggggatgcaattggtgaatggatggctagggaacactccggcatgtttcctgctaaggagcagcagaggaaggcaggcgatgcggcggtgagggccgggggtctcttcccgtccttcatgtctcagcaagcggaagggacagccccatcctaggagaaccatcatgagttctggggcagagatgcaggctggagtgggaagatgctgcccgtcgtgtcttgccatggccacggcgcaaaccacacagcctccccctc

SEQ ID NO: 394550 - DNA, 199 bp, Homo sapiens
tggagccttggtctgggacattcagcctccagaatggtgggaaataagtttctgttgtttctcagccaccacgtctgtagtatgtggaagtcatcagaatcaaaattgagtcacctgtggttttttttttttctaaatccctgacaaatagagcctaggaaggccaagaagagaagagggttctcatccataaacactt

SEQ ID NO: 394551 - DNA, 325 bp, Homo sapiens
ctctgttacccacttcaaattaatgattctatttttggctccagctattttacagttataaaactaggcattttacagttataaaacaagtcttcatttcaatatgttagattcaatcattttaccagaaacatctttttaaagtagcaatgacatgaaatgcccatttttccttttctctctgcatgttcatttggtagcatgtgatatacaaggtaaaattggaatgtatgtttttgtctacaacttaagggtaactgacctttgaaggaaaataacactagacactgactttgttgttttaacaacagttgtcagcagttca

SEQ ID NO: 394552 - DNA, 572 bp, Homo sapiens
aggtacatgccaccatgcccagctgatttttgtatttttttgagagacagggtttcaccatgttgccgaggaggtctcagactcctgggatcaagtgatctgcctgccttggcctgccaaagtgctgggattacagatagatgtaagccaccacacccagccagagttccaagccttgaagagaaaccaggtggtggagaaatcgtgtatggatttgggtaaaggagaaaggaagctgtggaaaggggaagaggctgagccagagttgtgggtaggagacgtacaaggaatggaggcaatgcagagacacggggcaagattcaggtgcctcgattccaccttttgtaattcaggggtcagggatcttgtcttacttttgttgttgctttggtatgctgcacagtgcctggcacataataggagctgaatgtatccttggagaatagatgcatgtgttttgctgtgttgcttcagtagtgcctactgtacatctcctatgagccaggagctgttctaggtgctaagttcctctcttgcagagtgatgtttagtgaaggagatgagggttgcaa

SEQ ID NO: 394553 - DNA, 560 bp, Homo sapiens
tgtgagccacctgtagcttaaagcttaaagtaagccaaaatgtacttactttaagtcaactttcagaaacaaagttttttttataaaaggatccgtatcttgtaaaagacacagatgcaataaaacttaagttcatttaaatgagaaataaaggatgacttaaagaagtatgaatggaattataccagaaaatctgtggtgaagataatgattgtaattgagttcaaaagttagctctgagtttctggcagcctaggtatagaagggaataggataggttgtgtgattgtttaacaaaggaagcatgggatataatgctcttttctataatgtcctttgttccaaatatttaaagtgtttttttatagatgtgaagttaaaccacttagataggtccagattgttgaaacccaagacctcagctcttgagatcatagcattaatccattgttcgtagtaggtcacactggtattttaaaaagtaaaaacttaagaaaaatatagggctgaactacatatatgcatttccttccttcttttcttttcctttttttttttta

SEQ ID NO: 394554 - DNA, 386 bp, Homo sapiens
ggtgatctagaggatcccggacatttccacgagccacttggtaggtttgggctggtagcatcgcccctgagataattttagctgagatcacagtcctccatgactcacagatgccaagctcgtaaacccattctaatcaccaaatagcctctacagacacaacccttgtaatgctgtactgaaaatgctcaagggctattttagaatgtgactattattccgaaaacagcttctccactccaaagactcaagcaacgttcagatccaggaggaaagaggacaatttttgctattagtacaataaaaagactataagttacttattttttagaaatggcaggaaagaaggaatttaagacttaggtaattatgtgacttgaggaaag

SEQ ID NO: 394555 - DNA, 527 bp, Homo sapiens
gaagtttaaaaagtaactttttaacccctttcaaagtcttccaaaggcagcaaaattgcttagggaggagtgagtatctactgacctccaccttccttcagcttttcactatcagccatagattttgtcagaaagtgtccttcatatgtttaaaagcccctgagaaaatgacagccacttggtaggtttgggctggtagcatcgcccctgagataattttagctgagatcacagtcctccatgactcacagatgccaagctcgtaaacccattctaatcaccaaatagcctctacagacacaacccttgtaatgctgtactgaaaatgctcaagggctattttagaatgtgactattattccgaaaacagcttctccactccaaagactcaagcaacgttcagatccaggaggaaagaggacaatttttgctattagtacaataaaaagactataagttacttattttttagaaatggcaggaaagaaggaatttaagacttaggtaattatgtgacttgaggaaag

SEQ ID NO: 394556 - DNA, 477 bp, Homo sapiens
acgtttttgcagttgaggaaactgaaataaaagtaagtaactttcttatggtcatgcagtttctaagtagcttaggcaggattcaaacaggtctgtctgattctttgtgtattatacctctaaactttcctgtttgttccttgcatttatttcacatatatctgatcaatcatttctttactgatatgcagaatcaataatgcagttttcaaaacttttatataataagttcatttgtctctgtttaaatcaagggtcttacatttttggctttcaaggcacagacgtcttgtatttggaggtttttattttttttacatttgaaatcacatgcctttaggtgagacttacacttgccagttagccacaatgactagcactccctgttgtgttaggccacctaacttcacacattcatgatacccacctggtccctgaaaactttcgtatttgtatccccaggattggcttgttagt

SEQ ID NO: 394557 - DNA, 193 bp, Homo sapiens
aaggcgtgtggctaggatgtggataccaggtgcgccccagcttctagctggggggcagaggatgaaaagacaggctgatatggggcagtgtctaaagagcctatgagactggggtttaggatgactgtgggtttaagtatagccgctgggacagccagccccacaagcatcttgcctaccttgggcctccagg

SEQ ID NO: 394558 - DNA, 271 bp, Homo sapiens
tagaaaattcagcaaaagctgtaccatgaagccaaagaaaataatttcaggcaggatgggaagacaagagtatttactgtttcagtaaaatgagaactgaaaagtgaccaatggattgaacaattaggaagatttttagggagcccagtatactgggctttatgatcaagtctgatttttaagtcccagctctgctgctaactgctcagccacaaatgtttttagtgaagggtggcagaatatgccatcccgaacatcccactttggcata

SEQ ID NO: 394559 - DNA, 318 bp, Homo sapiens
acccttgacacccaatcccggctgctaatggtccctcagggggcctgggaagaggcccagagtcattaccctttaaaataaaactcgggtagacttgcacgaattcttaccaggactcccaggtaagagacttctttgcttttctctttcttttgtttttgaaactagggaatgcttttccctactatcacatttgggattaagaaaaaaaaaagaactttttttcctattaccaatggacgtttttgtagaaaatttataatctgtaggaacatcagataagcccgaagataaacagtcatccataactcatcagct

SEQ ID NO: 394560 - DNA, 395 bp, Homo sapiens
gcaggcaggctcttagaagatatttggggcacggatttgagggtctcctgagatcaggggtcaggcagcatctgaatcttgtctgcctaggcacccattcttctcaaggtcactgaaggggacatggtggaggacacggactccacccacgcagcaagtcctcagcaagtgccttctgtgcaggtgtcccgggtgtcgcgtgaatgaactgtgttgtaggagacacctctgagatcatttccctatgtgatagaacaaaacagggtagctcccgagaggggctgggatagggagtgagcatgaacttaccctagaggtggtgctcacagcatctcagacacgcagggacctggagggagggcgcccacggaggagcaacactcagtgaggcagga

SEQ ID NO: 394561 - DNA, 496 bp, Homo sapiens
gtcatccaggctgtttacctcagcctatgcctgctgccccatgcctgattagcggcagcacagccatgttccttacacatggtatcaggcatgactaccatggaaaggtgctgggtactggccattcctgtcatgcaagtggccgctacagaagactctgtcagtgataatgccacccactttccagccccactttgtgaagaagacagaaacagccttttgggtggtcaatgcctacctttattcctaagatgactgactgtaatagagacttaaatagtaggaaaccagatttgggaaggtatctatgaaggcaaactccattaatttgtccattcattgaacatgttttatagagctgctggcctgcttcatgccaggccctgtttcatgtgctgggacatggaggtgaacaaactcagtgggcctcctccccaggaacttgcctactggtagagatgtagcagtgagccccaactaagccacagctaagctg

SEQ ID NO: 394562 - DNA, 312 bp, Homo sapiens
tccatgctctaatacccaagggcaacatggcgaaaccacatctctactaaaaagtacaaaaattagcacagtatggtggtgcatgcctgtagtcccagcttctctggaggctgaggtgagaggatcacgtgcactcaggaggtcaaggctgcagtgagtggtaattgtgccactccactccagcctggacaatgagtgtgaccctgtctcaaaaaaaagtaaaataaataaataagagccaagggagaaaaagaattttaagaaagagaaacaattaacaagtttaggaagctagcatcgtgggttttggat

SEQ ID NO: 394563 - DNA, 185 bp, Homo sapiens
cctgggaaagccccctggaggatgaggtatgccaggaaaatttcaaagaggaataggatttaattcagctaagtaaggtgagaagggctttcaggcaggaggtatagctgagacgagtacagtggtctgaaatagcatggtgtgtgcaggaggctgtgaggagataggttaaagtcaagcatgaa

SEQ ID NO: 394564 - DNA, 323 bp, Homo sapiens
ccggggggtggggtttgggaggcatgggtagaggacaaaagaatataaagtggtagcacaatcatgttgataacttaattgattcatgctagcaagaacactgtccttgttttgtaataaaccaatattcataattaaaatgtcccacaggcattaaaaaatatcatgcatggaaataatgaaaacgattgaatatttgactaactggtcaaactagattttgactgttaatataaaaaatcactatccttaccaagtgcacattgaaataatgtactaagcaacaaaggatttttcagtatatgataaatactggaaaaccg

SEQ ID NO: 394565 - DNA, 604 bp, Homo sapiens
  misc_feature (43)..(44): n is a, c, g, or t
atggtcatagctgactctagaggataaaccaaggtacaggcgnnaccgcatgcattccttgggatgttacttcgccaactggaaacctctgtagctggcggagccttcttcctgagcactgcttgtgcctgctggcctcattccgcccactcgacctggcaggctgtgcttggctcatgctaccggcccggatcccacacctgccaaaggcaagccaggcatggagcggtgagggctgtgtgggcgagtgagtgtgaggtctggctgctgtgcacagacagctaggcacatcagctgctgtggcagggcgggcagccccaggcgccggcactgactccatggaaggctgcggcttgaccagatgtactgcatgcagcttccactgcgggcacccatgtctggatgaggggaatgtggtggtgcctggaagcttggagatgccaggaactgcagagccccaaagagagtgtcacaaccctggctccgggagctcctagatgtgggctcccttctctccttcttgttgcccacaacgtggctaatggagtgggggcgtgtttcagccctgtttgtgttacagctctttcagccctgccattcagca

SEQ ID NO: 394566 - DNA, 425 bp, Homo sapiens
tacctcggaccggttgacgggcttcaaaaaccaaaattaaaatttttaaaaaccgaatagcgcacttgtaatttgtgataatgagattttacgtcacaaaaaatgctgttcagtgttgacacagaggtatgagactccgacttatttcctcaagctatgaattcagcttacataacaaaaggaggccttgaaatatcttgccttattatctcacttaggatgacaaagtttagtgatatttatagcaaatgataataaaataaaaaggtatattcttcaaagaaaaacgaacaacaggccgggcaacatggcacgactccgtctccacaaaaaaatagaaaaattagctgggaatcgtggcatgtgcctgtcatcccagctactcaggaggcgaggtgggaggactgcctgagcccatgaggttg

SEQ ID NO: 394567 - DNA, 688 bp, Homo sapiens
tgcaggtgtccttgctgacaaggacagccaggtagacacagggacaatggatggaggaggtgttatgcctgtttcctggctgccactaggcactaaggtaaagtggaaggcattctagttgttcccctcactttgggggtagagaaaatggaatttatttaaattcattcagtcaacacacttattaagcagtgttctagacccttgagaactgcacataacaactttgtccaaatctctgcattaggagacaatcaaactctagcatagcctcagcataaggctgtgtccctgggatgaccccagcccctcattaaaatgcttacctgagaaatgctgtcaggagaatttattatttgctctagtcaacacgttacaacatgcccccaacctcctttttttttaaacagcatttacaaaaatgtgcttatgactgtgaatacttaattcttacaacacagaagcatctccctcaaggacccgagagccattcctatggaatgtaatcatcaggaaggacagagcctctgcctcccaatctctggaagcacagaactttaactttgagaactgtcagccagtgggcacagtcggcctaattgcatctacagggaccaatgctctgtaagtcttcacctctctgacactactgaaaacccccactccacccactccctcaccctccctt

SEQ ID NO: 394568 - DNA, 107 bp, Homo sapiens
ctggaggatcgcttgagcccagaagtctagccaggggaacatagcgagaccccatctcataaataaataactgtagcaagatcatgtctcataagtaaatgaatgaa

SEQ ID NO: 394569 - DNA, 194 bp, Homo sapiens
tttaaatccttcacctactttccatgcttagcattgtttaaaccttggaattaggctctcttacttcctcgcccactattaccatatgcatcctgcaaatctacaatctattgaaactgaaatagctgcagtttctggaatatatttgctatcataccttttttcctttctgcttaagctatttcacagcttgt

SEQ ID NO: 394570 - DNA, 484 bp, Homo sapiens
cttcaaaatatttgtaaaagaagcagccaggatccaagaataaaaattccagttagtgttgtgtattctgtctggaattcactagctgtttatcttaggtgatgatcttactgactaatggaaatattaatggcaacatagtgagcttttcttctctagaagggtaagtgaactctcaggaaaataaatcactgtcggccgggcgcagtggctcacgcctgtaatctcaacactttgggaggctgaggcggatggatcgcctgaggtcaggagttcgagaccagcctggccagcgtggtgaaacccggtctctactaaaaatgcaaaaattaactgggtgtggtgacgggtgtctgtaatcccagctacttgggaggctgaggtaggagaattgcttgaaccaaggagacgaggttgcagtgagccgagattacaccactgcattccagcctgggtgacagagcaagactgtctcaaaaaaaaa

SEQ ID NO: 394571 - DNA, 327 bp, Homo sapiens
ccggcccgtcttaatcacatgtcatactgccccatccccttcagttggatagtccccataatttgtccatctgacccatcttctgcagggcccacacggcaggcacagtcaagagaatgtgaagggagggtctccaggtgcccagcagaggcgtccctgggaagccttccgaagtcaacccaaaaggtccttctatctggtccttcacacccactttccaatagcacatctggactggcagcaaggaaccttgccctgcagggcccgtccgtccgtccatccgtccgtccgtccatccatccatccatccatccatccatccagcag

SEQ ID NO: 394572 - DNA, 431 bp, Homo sapiens
ccctccactagtgcaggcacaggcaaatatttcatgacgaaaccacccaaagtgattgtaaaaaaagcaaaaatttacaaatgggatctcattaaactaaagagcttctggacagaaaaacaaaactatcatcagagttaacagacaatctacagaatgagagataatttttgcaatctatccatctgataaaagtctaatatccagaatctacagggaacttaaaccaatttacaagaaaaatacaccctcattaaaaagtggacaaaggacatgaacagacatacacagtaattttagaataagatctgctgtgctgtctcaaaaaggccccacactggaatgtagactcctttgttcaagactgctactgggttgagaaaagggtttgggcaagggcaagtaaatataccacaaatctttcctatgtt

SEQ ID NO: 394573 - DNA, 367 bp, Homo sapiens
ctcgtagacgtcatgagccattttcaacccaaaacgcatctcagggaacatctggggaaaatactgggttagggcaaaatgtgcaaagcgtcaaaacagtgctagaaacaaagtcctacagaaataacagatgaattctgaaaggctttgtgaagaaaacagaacttgagcggaggctttgaagaacgaatataaaagttcctcccccagaagggaagaacagaagcagaatcggtttaacaacacgctgcccaaatcgcctacaagagtaaaatggggacagaaagtaagcgacaaggttggaaatttagattgggaccacatcgtgaaaggactgagggcttcgatgggaccgcggcttgacacg

SEQ ID NO: 394574 - DNA, 414 bp, Homo sapiens
tgaggtcaggagaagtgtcttcacattgcctggtacacagtggttgcttaattcatgttttcaagtgtgcatatgaaggaagggagcgaaacaagcatgaccatgtgtttaattccttagagttttatagcttataggaagattggaattcagtgaaatggaacattgtttaggactgtttatatttgttttttccctggagtgactgatgatcatatttccagccagtcatctcactgttccaagtctgttttcatgtgtgtcatatgttcactctactgagttaccttgtagttcactgcttttgttgactgatgtgatagactcttagtaaataatatatatatatattttttgggatggagtctgcacttcagcctgggggacagattgagactctgtctcaaaaaaaag

SEQ ID NO: 394575 - DNA, 404 bp, Homo sapiens
aaccatgattgtggctcactgtagcccacatgacagagcaagaccctgtttcaaaaacaacaacaaaacaaaaacaaaccaaaaaaaaaagatacttttttaaattgtatatttacacttgttatacatatttaacgtgtgtgtgtggagggacgtgtgagcatgaccctactgcacagacgatcaactgtgtaccaactaattcacgctcccctttacaaactttacagctagtcccgccccgctagggaccacatcttccagacccccttgcatttggcaagggccatgtgactagttctcaccaatggaatgtgagtagaagtgaaagtgtctttctgggctagggtgaccttaggggtccctggatgactatgccacagaggtcaataaacttctaactt

SEQ ID NO: 394576 - DNA, 698 bp, Homo sapiens
caacctgtaatgatggtgggaaatgaaatgagtttgctaaatgcaagtgatgtcctattttgttcagtaaaggaagtataaatttagtcttcaaatatatgaaaacaggaagaaagaatttcagaattgaggaatatggtttacactagagaaagaattttctgactgtagtttgcaaaataggtggaagattgtagaatttctcaatctagatggttttaaaaatgtataaaattctcttgtgatgttttttgtcatacttggaagtagctcctctcttctaaccatgttacacaagatatttattttcccttatgagaaactaatgtcagtaaaggctattagaatactttccttgcgtactgcaaagacctaaatagaaactaacttcttaattatgaacaaataagatatgatgttttattctttacatcttatctgtattattctgttagtaatcagatgatgtgtctgcaccttgatatgatatacctgtaggtaaaactaaacattctggacttggtgatttatgattttaaaggtgctttttaggcttggggcttgttaaaacaaattctcagttggatatccaaaaacatacatgcatttgattattaaaaagcagctggaatggtacaacagtgtctttcaggttaccggttaaactggttatagagctgctcaactacagtatgaaa

SEQ ID NO: 394577 - DNA, 253 bp, Homo sapiens
atttgttattcccttctccaatagtgagaaacctggcttccattatcttcaatgtattgtctatttggtcatcccccttcctaaccaatctttgctgcccccaacaggtgcccttcttgcccaacttgggctccacattttatgccaggccaccctcccatcctctagtgtgggtgacttcgttctgtccaggctctgacacaccagccacaccatgctgcccctctccaggaatgccctccttgctctactt

SEQ ID NO: 394578 - DNA, 1273 bp, Homo sapiens
tgattctcagcatccagagaattgggagggcttttttccagggcttgttagtaacagcaactcgtgagcccttgtgcgctggcactgtgctgcgtgcttcatgggcacgatcgttttatcctcacagttctatgaggtggagactatcgttatccctcctttacagatggtaacactgagagttctgtaacttgttcagggtcacacactctggtaagtaccagagccaggattcaaaactcaggctgtgtgatcctagagccagtgctgtcagccaccatgggatatttatgctaatagcacacatatccaactgcgatgaatcattcgatactggaccctaatgcctgatagtttgggacgatgcagcctaagcactctcaaaccacacaatactgaggatatttgggaggtggggactgttcattttagcacacacaaaggaggatggagggaagtaaaggggtggaggccccgggacgttagtagttcggcacactccaggtccccacagcctcaccagggttccctcagggattgtggaagggggagtgctgtccagctgcccccaagaggcctgaaatgagtctttgtacaggtgagaatcccacaggaacaaacaagggttttctttacgcttgggaagctgctttttagattgttttaattcttgtttaaaatctgtggcccaattttaagttagtggcccaagccaatagtaaccttagcctaaaagattcaaactggagcattttataatttactttaagtatttgaagacatgtctttcttttccctctagatttcataaatcaaagcctatggaatggaatccttcaaactaactgctctttctttctgccacgcctccttggcatagtctaaacttggtagggtcagtgctgaaattctatattctttactttcatactctatcttacaagtattcccaaaggcattctggggatttaagaggatattttatggtcataaatgtagttgtcctagattgccaatgtggaaactgcaatattgttgttacatcgggatttttagtttctttagcatccccccactttgccccatgtatgtcagttgtgtgtgtttccattcccattagggaggatcgtcaccgaggaactgattctctgtgaggtttgcttcagggttgtaacctgccttcctgaggtggaagcagagctgctcttctctgagggccactcttggatctgcagattccctggaagtgttttgctaatggagtgtggtacct

SEQ ID NO: 394579 - DNA, 296 bp, Homo sapiens
tgtgtgtgttgtgtgttgtcagtgttgtatatgttgtatgagtacattgtacatgcatgttgtgttgtatgtgagttgcatgttgtcagtgtgtgcgttgtgagaggcgggggcatccacgtgactgctcctcagcaagtcctgccgtgcagccccttctgagcgtgcgtcctcccgagtagcctagaagcagcagcatgtttgcctctgcccctccccaggaggcctcagccaggtcctgtgctcagcctgccgtgggccatctgcctctctcgtctctctctcgtcgtcatcct

SEQ ID NO: 394580 - DNA, 443 bp, Homo sapiens
tccttcagtcctgcagaacatggcacaataaccatgactataggggtctcctctgcactgtcccacccaatactacccaaattgaaggccaatcttaaatgtcaccattccttgaaccctccatgctcccatccctacctggctagaatttttatctcaactcccacaatgtcttatctatacaatttattatttggcatttatttgctcaacaaatatcacttgcacacctatttttgatttgaagatacagaaatataaagaattaccattgctctcaaggaaatgcagcccagttcaacaaatggcctaaaatggaggaagcagagacaataacagtcagaggagtattccaggcagaggtggtatcagagcaaaatcttgaaaggactgatagagtgggcaatggtgtttcagacaagggaacactatgtgtgaggtca

SEQ ID NO: 394581 - DNA, 310 bp, Homo sapiens
ggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcaccagactggacaacctgcgccaattccaccagcttcgagacctaccggatgagtgtacagcatccccaggctgaccgcacggccatatgccatcatagttcgatgataagatgaatgcaccttcagctcataggtgtcggaccccgtggtttcgcatc

SEQ ID NO: 394582 - DNA, 604 bp, Homo sapiens
gctgagaaagggaagattagaagaggagaagattgtggaagtagagaatggagagctgagtgcgggatgcctgttaaacatctgaattgatccatctaatgggcgcctgggtatatgaatctggagcttgggagaaagatctggacagacagtggggagtttatcatgtgcctgcaaatagcattttctcctctaaatccaaataaaaaggaaatgtttcaattcaatttaatctaaaagataatccatttttaaatcgtcctgtatctacacagatacatctttaatccagtgagggagaagatgatctttttcttttgtgtttttgtgggcatggtcatttataactttctaaacacgagtgggccactgtttaactgaggaagatttgcttttcacatctaagtctcctgaagcaagacacagtctccatttcccagaagcttgtttgggaagatggggcatggcaaacaagagaaaaggttgagacaggattgccagcaaaagatggatctgtaacacacttccctgtgtaccttttaggcaaacatagaaatttcagttctaagaatccagctagggctgggcacagtggctcacacct

SEQ ID NO: 394583 - DNA, 191 bp, Homo sapiens
cacctggctatatttatgttccgtgtcagaggaagggcgggcgaccagggttcattccaggtatctgagtctgtagtcacacgctttccattgaatctgagtatgcttgttagtgggaactttcactgaaggaaaagaatagtgagtccttcattaagacttgtgtttatcagtggctgatgattgaactg

SEQ ID NO: 394584 - DNA, 209 bp, Homo sapiens
tgtttcaattcatgattacatgggggaaggacttggataatgtaattcttaagtgatttgcaatgtgcctttcaggcaggttttatttacaattctacatgaagcctgctctcagtggctgggagaaggccagatgagtgtttgctggctccattctccagcttagactagagctggggatgaacaatgcagatcaagtggcaggactt

SEQ ID NO: 394585 - DNA, 306 bp, Homo sapiens
gctcagtgtttagctcccacttgtaagtgagaacacacagtgtttggttgtctgttcgtgcattacttagcttaggtaatggcctccagctccatccaggttgctgcaaaagatatgctttcattctttttccaggcagcatagtattccatggtgtatatgtaccacattttctttatccaatccaccactgatgtccacctaggttgattccatgtctttgctattgtgaatagcactgcaagtgtcattttggtacaataatctatttgctggggaggggctgtatatacccgtaatggaact

SEQ ID NO: 394586 - DNA, 511 bp, Homo sapiens
acagagcagcctaacccccggggaccgcggcccagcaccagcaaagagacctgtgccctgtgtccagcacagaaacagagggctgctgggtctcaagggacttctcaggccaggaccataagacagcaatgcctccctgatgcactacaaatttgaggtcctttcctagtttttcccagcaccacatgaacccctcagattcctgtgtggccctaagggacagagccccagttctgactgaagtggaatttcctgccagtccagtgcaatacacactcagatttggatttaaatggatagaaagaaaatgaaaaacaaattgtgttgctaatgcctccctgagatggcagaactcttactgcccaagcaacaagtaatgatacagagcccttagtgctaaggcagtggcagtgcaggacaaccaggggacacccagacccagcactcgcagcctggggagctcccggagagaggaggggtgggagaagagcctgcagagggcctgagggct

SEQ ID NO: 394587 - DNA, 811 bp, Homo sapiens
ggcagcattggtgcggaagtaactttatagtggagaaacctggaaaacactgtctcagttagttgacttcagcaaggtcaacatcaacagtggtaagtcatgttggtagtatgtactcctgatatgatgtaatgaaaacaacactttacctctattatcttcctttctgaaacccatatcccagtctaattataagagaaatagcagattgagagacacaatggaaggatattatacaaaatacttgttcagtactccttaaaactgtctaggtccttaaagacaaggtaagtctgagggaaagccacagccaagacaaccccagggggatatgacaacaaagtataatgtagtcttctggaacagaaaaaggatttaggtaaaaacaaaggaaatctgaataacttacggcctttagttaatactgtattaaactctttcattaattataatgaccgtagcatatgtaagatgttatttataggggaaagtgggtgtgggcatatgaaagctctgcaatttttcagaaattcaaaagtgttctaaaatttttaaaaagtttatttaaaattatctatgtactttctgattatggcaaatcctacaatactaaaaattaatataaaactcaattactatttgctttctgaaggcttgtatgaagttgctgatatcctgtactcagagcccacttcacgttaatggaaactagaataatttttaaaaacaacttaaatgaaagaactgtaagttttgatgttataagtgcttctctcaagatgttttcaagtcttctctaaggacaagtaac

SEQ ID NO: 394588 - DNA, 701 bp, Homo sapiens
atatagggcagttactttaataggactcccactctcaagaatgtgctgaggattgaaagtcagtggttgtatgtgtaggagagggtggtagttttgttttataaaattataaagcagttaacattcagcatacatagctgaataataaccatatccctgatatacaatgcatagatgtatagtctatttttgttttgttttttacttccaaaaatgctgacaccgatgaaaaacaaaaacaaacccttatgtttcaaatgtgcttttgtattttttagcattttcatataggttctctaccaaattactacatgttttgtttcattttagcaaatagaaaaggcaaaataaatattttaattatgctattatatataaaaatatcatggaagaaatatggagctccagacaaatcagtcaatttaaggtttacagcctcctcagagactctatcattatatcaaatgcacaatgattgttttggaaattttgaaattcctggcttttgtgtcccacaagttgctgcctaaaatgctgcgcatatgcacctttaataattaaccaaatattggccaggcgcagtggctcacgcctgtaatcccagcactctaggaggccaaggcgggcagatcacaaggtcaggagattgagaccatcctggctaacacagtgaaaccccgtctctactaaaaatacaaaaa

SEQ ID NO: 394589 - DNA, 484 bp, Homo sapiens
aaccagtatatatctgcttgggtcttgaatacagtacagatattattgaactaagttgttctaaaaggacccaacctatgagcaaaagaactggagactgaattcatgggtgaaccttttttgagtcatggagcaaatcaaggaatattttctgggttagggaagtgggtactgtttttataccacagagtagtgggttagagaaagggaagacctaaggaggaatgcctagaaaaatgcctctttttttattttaacctcttcattctgacttctgactcaaaggcagttttaaaggtgtaaggctagctgagggagagaaaacttaacgggcctctagcttggtagctgccgataagtcgtgtgtacagataaatgcttctgtgaaatttaagactccttttgaacaaagagggtgtgcccttggaaagagagcatgtaaaaagcggttgagagttgttctctagtgtattgaaacatgcct

SEQ ID NO: 394590 - DNA, 268 bp, Homo sapiens
agtttccaaagcattcagtattagtaaatcagactgggagtaatttcatttggaacataatgtcccttggaaagagttctgtggtttttctctaatttaaatttgaggccagactgatgaatgctatgaccagggattatgtcatagaacagagaaatacagtaatggctcacatattagaaatagaccacaagctagtatctgtcacagtgttgctaggtactagatagttctttgtaataaatgaaagttgtggaagtttcatatc

SEQ ID NO: 394591 - DNA, 237 bp, Homo sapiens
tccttcagtctgtggctggaggcccaaagctccctgggcagccgtcagtgcaagttccagagccctaaggccaaagaacctggagtctgatgtccaacaggaggaggaggagaagcaggcgtctggcatgggaagaagaaagagagccagaagactcagcaagcacatttatccatcttcttccacccgcctgttctagctgcactgcacctgactggatagtgcccatccacatta

SEQ ID NO: 394592 - DNA, 131 bp, Homo sapiens
aagcaggccgcgccgctcgctactgattaggtttaccacggattgacttggtcgggtttgtcatgggtagagttagtgactgtatatggcacaacagggactgtgtgtcatgagctagttgatggttaaca

SEQ ID NO: 394593 - DNA, 519 bp, Homo sapiens
cggggatggcgtcacctctcaccccaaatcaggaccctgggccccagctctgttccccacctcaccttccttgtgaccaactcctaataaccaagtgaaatggaaggagttgtcctcagcaaaacgtgtgtgcggaagttcacagtcactttctcggtgataaccaagagctggaaaccactgcaacacccaccagcaggtgaacggattaacacactgggctagggccacacaatgagatgctccgtggcaacacaaaatgaaccgtggacacacactgcacggcggatgaatatgcagacatcaggccacgtgaagggagccaggccccgaggcgccacgctttgtgattcagggtggtccctctgcgcccaagacccggctgcctcctcctcttcctggctgcagggagtgcttgtgtctgaagaacgccaggctggtgtccccagagggcggctggaggggctcagaaaccattttcaccttctgtctcctccatgtctgcactgtttgggtttg

SEQ ID NO: 394594 - DNA, 353 bp, Homo sapiens
ctgggcctttgcactgccactttctctgcctgggacgctcttccctcttcctttgcacagctgactcccccgcttgtcggccagatttttgctcaaaagtatcaccttctgagggacctacccctgactctcagctaaagaggtccctccagtggctgttccgttttctccaacatgtatgttgtctgtctcctccttttttttttctttgagacagggtcttgctctgttgtccaggctggagtgcagtggcaaaatcatggctcactgcagccttgacctcctgggcttaagggaggcccaggagggggggcctttgggaggccacctcagcctcctgagtagctgggacc

SEQ ID NO: 394595 - DNA, 842 bp, Homo sapiens
gtacccgacggggtgtagtgggcttagaagtcagttctgccttggggacagtggcatgcgaggtgcaggcaaatgggacaggacactcaagtcctgggaggcaggaaagacacgtgtgtctgcggagtgtacacagtgccagcagtgcagctggacaggacaaaaaaggagatgggggtgggggcagccagggactaagctgatagctggacaaaggtgtttcatctgaggaagccatcggatctggcggacacaggaggttttacagaccgaagggcttggccagtcttgccatacagctcccgctccctctgattcgccgcggggtggacacgtgtggctggcagcttttgggctttgaagagcctcttccccatcccaccctagatccatagaaggctgcggagagaccctcagctccgcccccacctcgctaagtgctagcaatagacccgccccagctgtgaccccgcccaggaagcccgctggtcactgcctggccaccccagagaaccgtaggggccagccctacgacagtccccacctaagtcccggaaatgcagagcgaggctagctgctcagccccatctgatgctatttttatgcaacctaaagaggtcgaccccgtcttatgtcggtcgcaccgtgtccctcccaggctccactagcacctgggctgctatggtgagatcaagatgggccccgcccacaactaacgatgttattccgcagcgagtcaaagccactccctaccctgggcccgctacgcgacctctgccggcctccgccccacgcggttttagtacggcgccaaggccccgcccacaaatcggccccgtccc

SEQ ID NO: 394596 - DNA, 592 bp, Homo sapiens
agtgggaactggggagtgattgcttagtggggatggagtttccatctgaggtgaagtgattttggaaatagtgctgatagttacttagcactgtgaatatgtatgatgccactgaattttacccttaaaatggttcagatggaaaagttgattatatgtattttaccataatttaaaaaagtatatactcataatctctagaggaaaaacacaagtagcaggaaaaatcgtatttgtccccaaaatgactattattgcagtaggtgggcttcatgttccagagctttgggcattaatattagatgagaatgaatttgttattattgtgtttctcatttgtgctagacactgctatggtaactggggttatagagatgagtaagaaaggcacaccctctgcatcttggagataccagtgaggatggccaagaaacaacaagcaaacatagaaataagcaaatttaagttataagtgccatcacggaaacaagctagagatgaaaatagaaatgtgtgtgtgtgtgtgtgtgtgtactggtgaggatgaagagtttgggaacatcctgctttattaaaaagaagcatgagattc

SEQ ID NO: 394597 - DNA, 477 bp, Homo sapiens
tttcagtttcagcctgggagaccctgggcagaggacgtcattgcaccatgacctccagaactgtaagctcaggcaggcgtgttgctctaagccaccacatatgcagtagtttcttatgcagtgtaaggagctgatacgcaaggccaggatgggactggttggggtctccaggctggagggccccccggtgagcaggcatggggtcccacagcccaggacagcttcagctcttatttgccatctgctgctgctaggtgttagacgctggactgagcatgctgcacacatcatctctgctgttttccttttttttttttttttttggtggtttttgttttgttttgttttgtttttgaggcagagtctcgctctgtcacccaggctggagtgcaatgacgccatctcggctccctgcaacctccgcctcccaggttcaagtgattctcctgcctcagtctcccgagtagctgggattac

SEQ ID NO: 394598 - DNA, 308 bp, Homo sapiens
ctgtgtcctctaattagtaataatggccacagatagattttataaatatttcttgggtagcacatttattcaagggtacacaaagccagttgaacagagagaagcctaacatgaaatatgatagatgtttatttcagtttatggtggggtcatcatgcttttatcatacaagatgactggttattttgtctttattttgtgttcgaagttggcagtaccatgaggctgttgcatgatagggaaaagaaaaaatgaggccaaactttcttctttccctgagcattattattaatggtctaggggctact

SEQ ID NO: 394599 - DNA, 439 bp, Homo sapiens
attagaaggtttcctcttggcatacagtattttgaaaagctaaatcctgatttcttgttagaaattgttatggagtatctgagcttctgtccaatgcagcctgcaagtcctgggcaacctctttgtccacttctcaggcgttgcatctcagtcctggagactgtagtaagaactgttccaggtcttctgcaaacagtcttcctaatagcaaaagtgaaatatttgtcaggtgatattgaagcagctttcaataaccttcagcactgcttagaacacaatccctcttatgctgatgctcatctgctgctagctcaggtttacttgtctcaagaaaaagtcaaattgtgttctcagtctcttgaactttgtctgagctatgattttaaggtgagagactatcctttatatcatttgataaaagctcagtcacaaaagaaaa

SEQ ID NO: 394600 - DNA, 501 bp, Homo sapiens
gtacaacagtgctcatataacactatataactagaacagagagctctgcacaaactaagctgtacccctctcgcccctgtatccctactcaccctccactcctcagactctaaagctcctcccctgtgaagcatcccccatgcacatgtgctcagcctggcctatccataccctgcatctgttcatgctcctctcacttcccagatggagaatacatgcaactgttacttatctgtctcattctcctgagggcacagattctacctttatatctggtttttccaatattcactgagcaaacaacagtcaggaacagagaaacaggtggtctaaataggaggaatctgggaagggcttatgtcatagacaaaacatggagcagaggccttcctggctcttgcacacctgcttggtctgtccagctgatggggtcttagaccaggccaattcaaacaagacacactgtctctcctcccgtgcctggtactactgaggtgtaag

SEQ ID NO: 394601 - DNA, 378 bp, Homo sapiens
taggtacctggacctttgagaacgtgacactagcaaggtggtgaccacagagaataggtacaaaggtcttgaagcttgcttagagctttgttccgtggtggcacacaaatcttggcttgctgtaccatcattggcaaacctcatcatatcacagttgggtgtgtttgtatgtgtgtgagcactagtgtgtgtgtgtacatattcgtgtgtatgcacactttgtgtacctgtgtacatgtgattgtagatgtacctgttgtgtgtaaactctgttaaaatgaaatttgcttcgcatttaatgtgcaactttgaagtagtgtaatatttatctaaaggttttcactacttggttttaatgtctttgaacgtgtacttcta

SEQ ID NO: 394602 - DNA, 346 bp, Homo sapiens
aggactccgggcatcagaccgacaaggctggcagggggtaagggccttttccagagcaaggggtcacacatgcaaaattatcaaggtgagaaaaactactggacgagagggaatggaggtggctctccatgggagaattctaaggaagagagtcacctggcacaattggccctggggaacattccttctgtctagtgtgaggagttggggaaagagggaaaaggctggaagcagttccctttggttgagtgacagaggccaaccacctgcgctatccaggtgggggcatgccgagaagctgtggcgccgggccggagaagctgtgcgccggagaagcttacgcgga

SEQ ID NO: 394603 - DNA, 481 bp, Homo sapiens
aaataaataacattttttcatttataatagtaatacaccagtcatagacaaattaggaaatatagttaagttggaaaatacaacaaaaagaacataactcatgatcccattgctgatattaagcattgttaatgcctctgtgaatatcggggcttccttaactggaggtctctgagttaatggatggcctgtaaggtttctttgactctttgaagaaaatgtggaaaatttgtgagcttacataaaggcagtagggttttgtgttttttgtttttgttttggggaggaggaggaggagaggaagtatctataattttaatcatattctcgtagggatccatactcaaaaggagaatcagtcaccggctggctgcagtggcttacctgtaatactagttttttgggaggctgaggcaggaagatcgcttgagcacaggagtttgagaccagcctgggcaacatagtgagaccttgtctctac

SEQ ID NO: 394604 - DNA, 429 bp, Homo sapiens
tttagacgatgcctcgctctaacgcccaggttggagtgcagtggtgcgatctcggctcactgcaacctccgcctcccgggttcaagcagttctcctgcctcggcctcctgagtggctgggattacaggtgtatgccaccacgcctggctaatttttgtatttttagtggagatggagtttgaccatgttggccaggctggtttggaactcctgacctgaagtgatccttctgccttggcctcccaaagtgctgggattacaggcgtgagccaccacgcccagcctttcccaccttcctttaacctccttccagaagaaagaaatagccaatttaaataaacatctattgtgtgttgattttgttgtctgtgatgttcaaggtactggagaatgagctgtaaataagacagacagcaattgtgcccccca

SEQ ID NO: 394605 - DNA, 871 bp, Homo sapiens
ttggaatgttatatattttatgagaaacaattaaaatgtgtaaatagcccagtaataaagttttataatcttttaaatcatcatagaatttttccttaagactttatggttaaatattctcttcattagatgtggcttacccgtggattctagagaagaaagcagatgggagcaagtgtacaatacagcaacggctcagtcaagtagttctggcagttatttgaagtctgaggtttgaagtaggaattcttacgggcatttggggaatatattttctgttgagtcctatactagtaagattttcaacacaaggtgactctcgacctcgccttgtaggaagagtgctgagaaaatatttcacctgctctttctccataaagagctgatactgatcattgctattttcttattcgatttagttaatttttttgacatggaactgttagcttttcatgctgctgcaaaggcttccttatattcttctaactcagtgtgaacgtgctttataagcagtttgtcatttctgaaaattttacgtttcacatctttaagtgagagttcccttcttattagagaaagctgattattatccttggttaactgttctattggctactaaatcgggctcggtcctatcacggcaggcaatagaaaaagtgactgttagctacgccgcagaactggtaggtgtcaagccctgactgggtcagcaatcgtacggcgatttgagtcgatgggataagaaagtcccgggacatccccgcgagttatcttccatttgaatcgagaaaaaaatttgagagattcgtagaagtcgcgatttagatccaggcccgccgttttttagtggaatcgaccaagtacatggatg

SEQ ID NO: 394606 - DNA, 185 bp, Homo sapiens
agagagaaaagaaagggaaatgaaaaggagtgaaaagggaaaacagggacatgagacaacaggaataacattttcctccctaggaattttgactagtgtcttctctgacagctggctacactttgagagtgatcatggcaatgctgcaaaggagaggacatgaaaaagtgtttaaaaagatcaat

SEQ ID NO: 394607 - DNA, 333 bp, Homo sapiens
cttcagtggacagtgctatggcctgaccagaaaataaccgccaataccccctctgtcgagtaacatgctcaagttgaccagccagactcttatctctaaacctatgtggacaagtgccacagctcgcgaggctgggtccctgaagatcggtgctttacacttaacttggtgacagcgtgaaagacgtccttaagtaaaacgtttagaatccggtcgctctcctccctcttctcttgctccccctaccccagcattaattaactagtctcattttctctccctctcccagcacagactccaggttacatcttcatcctgctggtgttggtgtgg

SEQ ID NO: 394608 - DNA, 435 bp, Homo sapiens
agattcctgcaattctctggtcacattttctctaattgatcaatgcgtaaccttgttttatgtgtgtttctatttaaagacgtcttatttgatacatattgttgattcatcaatattgaagtcagggccagcagcactataaatactgatgcctgcttgaatgaagcttctctaatacatgtgtttcctctgtaacacaaaagtgtatcacaattaacactagatagcatttcactaagcttggggattatttcaaaacagtgaaatcatcaacaaaaagcacaaaaatgtgaaaactgtggcactaaatagaccacaagaagtacactggtttatagttgaactgggaaaaaaggcagagcgttgccttcttagactccagctggaagtgtgtgtgccaggagacccagctttctcccagccctgggcatgtct

SEQ ID NO: 394609 - DNA, 492 bp, Homo sapiens
ctattcccacagcagactgagctcttcatagtccctcagcttttggtgccactggctctccatcagagatcaggatgattacacggacctgtagggcccacaccctagctgcaaaggatgctggaaagtgaatctctgcatttgtatttttcccactgggtggtggactctgctgcccaccatgtgtcataaggaaggacattttccaagcacagaaagggatctaaaaggatgacagtgggtacacacagaaaaaactctctcaagccatgttcttcctctaccctcataccacaacaatcaacacagaagagttctgtgactgtattggttgattttcacactgctataaagatatacctgagactgggtaatttataaacaaaagaggtttaattgactcacagttctgcatggctggggaggcctcaggaaacttacaatcatggtggaaggggaggaaggcaggtcttacatggcagcagaagagaa

SEQ ID NO: 394610 - DNA, 484 bp, Homo sapiens
gtggaatgagaccaacagccattatagccttaaagaaatgacaaagcattttcaaacttgcgatgtccattgacaatgttttggtgcattgcagtagaacagagctcttatccaggctccagtaagcactttcacctgctggtagaaaaatgtctcttcttttaatattttactgctaatggcattgtcacatcaccaaaaatatatgtagaaaaatgttatatttccctacctgtgtactttatgctatattaaaaacatctcgtgactctaaattcaaaatgtatccaggttttccaacaactctgattaacatttagcaattactttggactcattctccaaacatattattagttctcatgcagtattacattcattaatgtatattttcagatatcaaaatcagtagcctcttccacaatttcatatctttaatttctcctgtcttaaaagtaagttttaatgaaatgatttcttctat

SEQ ID NO: 394611 - DNA, 337 bp, Homo sapiens
aagagctcgtggagtttgccttgtggggttttggacttgcttgggccccaccaccctttccctgttgcctctttctctcttttggaaagggagcgtctgtccagtgcctgccctactgttgtattttgggaacatgtaacttgtttgggttccgtggtttacggctggaggggagctcagcttcagggtgggcgaatcgcactctgagtcccacccagtcctgattcaggtgatgttttgttgagacttgggacttcacaccttagcgctgatgctggaataagacttctggggctgttgggatgggatgactgtatttgccatgcaagaaggatat

SEQ ID NO: 394612 - DNA, 214 bp, Homo sapiens
gtgaagtcccaagtctcaacaaaacattacctgatatcaggctggaggggagctcagcttcagggtgggcgaatcgcactctgagtcccacccagtcctgattcaggtgatgttttgttgagacttgggacttcacaccttagcgctgatgctggaataagacttctggggctgttgggatgggatgactgtatttgccatgcaagaaggatat

SEQ ID NO: 394613 - DNA, 122 bp, Homo sapiens
tcaggagtttcccaaagtctgagctagagaggaattaacaaaggtcgccctcttggttatctagatggggtcaatgaggcccagggggcccaggtctgctccacaccactgggcaacagaag

SEQ ID NO: 394614 - DNA, 228 bp, Homo sapiens
tgcattcctgagatacacccagtttgttcatgatatattacgaccctcaaagataatgcaagtgttcttgccactgaatgcagaaccactgaaaattaggcctacaaaaagagggccataattaatttcaatcttctgttttatcctccatctctctccatataaagtttctaggcacttacataaactgcttttgcaagtttttgaaacattaagactcagttttta

SEQ ID NO: 394615 - DNA, 409 bp, Homo sapiens
ggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaa

SEQ ID NO: 394616 - DNA, 1230 bp, Homo sapiens
gagaatttaacagggagagcagaggagatggagagataagagaagaggcggtaatatatagagattgaggacgattgaaagattggggagaaggagcaacaagaggttaaataaggtttggggaaaaaaaagagagatcagactgttactgtgtctatgtagaaagaagtagacataagaaaccccattttggtctgtactaagagaaattagtctgctttgagatgctgttaatctgtaaccctagccgcaaccctgtgctcacagaaacatgtgctgtgttgacccaaggtttaatggatttagggctgtgcaggctgtgctttgttaaaatgtgtttgcaggcagtatgcttggtaaaagtcatcgccattctccagtctcgagtaccctgggacagaatacactgtggaaggccgcagggacctctgcccaagaaagcctgggtattgtccaaggtttctctccactgagacagcctgagatatggcctcgtgggaagggaaagacctgaccatcccccagccagacacccgtaaagggtctgtgctgaggacggttagtgaaagagatagccctctttgcagttgagataagaggaaggcctctgtctcctgctcctccctgggaatggaatatcttggtgtaaaacccaatcgtatgttctgtttacagagataggagaaaactgccttatggctgtaggtgagacatgctggtggcaatactgctgtttactgcactgagatgtttgtgtaaagtcaaacataaatctaccctacatgcacatcgaggtacagcatctttccttaaacttatttatgacacagagagctttgcttacatgatttcctgctgaccttctccccaccattaccctacagtccttccacatccccctctctgagatggtagagatagtgatcaataaatattgagggaactcagagacctcggctggtgcggatcctccgtatgctgagtgctggtcctctgagcccactgttctttctctatacgttgtctctgtcttatttcttttctcagtctctcatctcacctgatgagaaatactcacaggtgtggaggggctggcccccttcaataaggaccagacgctgtggctcatgcctataatcccagcactttgggaggctgaggtgggcggatcacctgaggtccagagtttgagagcagcctgaccaacatggagaaaccccgtctctacta

SEQ ID NO: 394617 - DNA, 543 bp, Homo sapiens
tgcctgagcctggtctgcaccccagtgagccgtgtatccagcccctgctgccgagtgacctgtgagcccagcccctgccaatcaggctgcaccagctcctgcacgccctcgtgctgccagcagtctagctgccagccggcttgctgcacctcctccccctgccagcaggcctgctgcgtgcccgtctgctgcaagactgtctgctgcaagcctgtgtgctgtatgcccgtctgctgtgggccttcttcttcatgctgccagcagtctagctgccagccagcttgctgcatctcctccccgtgtcaacagtcctgctgtgtgcccgtctgctgcaagcccatctgctgtgtgcctgtctgctctggggcctcctctctgtgctgccagcagtctagctgccagccagcttgctgcaccacctcctgctgcagaccctcctcctccgtgtccctcctctgccgccctgtgtgcagacccgcctgccgcgtgcccgtcccctcctgctgtgtccccacctcctcctgccagccaagctgcggccgc

SEQ ID NO: 394618 - DNA, 469 bp, Homo sapiens
tacttttccacaggcatattgtctctgtttctgtaagtcgttcaccatctgttcctgaatccctgttacatagattctcacctcctacaagctgttgttccaatgttaccttctcagtaaggccttctctggacattctaaaattgcgtcacctctattcctcttcccttcttcatttttctccgcgatacttcttcctctataacatattatatattctttcttgtttatcttattctgtagtttaccagctaacaatgtaagctccatgaggtcagggatttttatctgcattgttttctgctatttccctgctgcctaaaacggagtctgatacatagtaggtgctttgtagcattggtttaatgaatgttgaatatgtagaatatgtcccaactcctcagtgtggctttcacattgacctttattttctcccctacctgtcccctggaaaagtaggtaccgagcg

SEQ ID NO: 394619 - DNA, 571 bp, Homo sapiens
tacttttccacaggcatattgtctctgtttctgtaagtcgttcaccatctgttcctgaatccctgttacatagattctcacctcctacaagctgttgttccaatgttaccttctcagtaaggccttctctggacattctaaaattgcgtcacctctattcctcttcccttcttcatttttctccgcgatacttcttcctctataacatattatatattctttcttgtttatcttattctgtagtttaccagctaacaatgtaagctccatgaggtcagggatttttatctgcattgttttctgctatttccctgctgcctaaaacggagtctgatacatagtaggtgctttgtagcattggtttaatgaatgttgaatatgtagaatatgtcccaactcctcagtgtggctttcacattgacctttattttctcccctacctgtccccaagagctcacactgaatcaagttaggtacacttttctagtgtgaaattttctgattccatcagaaacatacatcattgaagagggccttcataatgcaaaaggagtacgcagaagataggttc

SEQ ID NO: 394620 - DNA, 423 bp, Homo sapiens
ctctagatagcatatctaccaatctctgctacttggggattagaattctgtgggatcatgcccatcaactttctaaaaatccttttgtcatgctgagaacgtctgcttacatcttaattcttttagtgatcttaagaaaggaagctacagctacatccttgagttgatctttgttcaagggctttgttttattttcaggagactgcagatgaaacagttttattttccaacccagcaagttctagttgctctagatttcttctagattctgcttataaaatgactagctctttctttagttcatctctatcttgcagaaccttatacttagctaggagcaaccagttggcgtttttggtattctgcttggaaattaatttgctaagtccaaaagtttcttagatacattttctgaattattcc

SEQ ID NO: 394621 - DNA, 418 bp, Homo sapiens
ccagggagctcgaatgagtgacggtcctggtgtgggttcagccataacctccaggacagatgagagcaggcacttctaaagggtggcccttccgagagggaaaggcctggagccttacgctggagcatgctcactctgggggtctagcgccgagtcccgggtcctgagggacacactgtgagcctggagttggtgacggctggggacatactgtgagcctggagctgatgacagctggaaccggacggtgcactgtgagcctggagctggtgacggctggggacatactgtgagcctggagctggtggctgctggagacatactgtgagcctggagctggtgacggctggaaccagacattgcactgtgagcctgcagctggtgacagctggggacatactgtgagcctggacctggt

SEQ ID NO: 394622 - DNA, 191 bp, Homo sapiens
ggagaagacactgtcactcctgccatttggcaaacaggtgtgtgggatttggcggctgggcattcttttcacccactttgatccagcaggagctgaaatcactgcaagtttcccaagtgggctggagatgagacgaacccgatccacctgcggattgaagcagagtggcccggcagggagcccagaccagc

SEQ ID NO: 394623 - DNA, 747 bp, Homo sapiens
gagtgcatttccagctttgttctgaggtcttcacacattgttaagtctttctctttccctgtgagagtgcttaccttgattgctgcaaagtataaacaagctaggaaaaactgcatatgaacccacacagacgtcattcctctatttacgaatcacacctgaggtcattcctgtcaaagaaatacatgtactagcagaactgatggtctgtggtacagcttcttgaatctctgtaccagtatttgaagaggcagctatcttcagagaaaatgttatcagttggattggattgattcttgggcacgtagaagacacctgatgaatatggaatgagtatatgattctcccacctcttgaaagttattttaaattattccctctgggcaggcatcagcttattttcaagtaggcttttatgtcaggtcattccttagtgcatgagataatttcttcaggggcttaagctgtcctagtaaggagttgatacggctccttgcagcctggccaattgctaagaagtggttcaggcctggtgattattaaagatctttgtattggaggcatgcatttagattaccaagatttggatccttctgtttctctcagatggtgaaaagaagtgtgggtgtggttgaattcatagcaccatcattcatttgttatttcatatttatagaccaccaaatatatgagaggcacttggggaacaatgatgatcacgtcctccaggagcccagtgggagatat

SEQ ID NO: 394624 - DNA, 321 bp, Homo sapiens
gacaactaaggcagagactggcattaatgcagttacaagccaaagaatgccagaaattgccagtgaatcaccagtagctaggagagcagcaaggaaggacactcacccgcaggtttaggggggaacatgtccctgctgacacctcaattttacacctctagcctccagaattgtgagagaatatgattctgttttaagctgctcaatgtatggtgctttgttatggtagccctaggaaaggaatacagtcaggaacactcttgtccataggcaacatgggatgtagcaatgtatggccaaatctttctcctcccaccatac

SEQ ID NO: 394625 - DNA, 128 bp, Homo sapiens
tacacatagtaggtgttcagaaaacactgagatgtggatgacaatctattcagtctccacaaagaataaacggactttaaaacatagcagggggccgggcgcagtggctcacgcctgtagtcccagaa

SEQ ID NO: 394626 - DNA, 193 bp, Homo sapiens
gtgtgtgtgtgtgtgtgtgtaagatgaggactttcagtgaaggaaagggattataccaaaaaaggtacaattccacctgtgtttttttccatcactgcatatttttaaagttgaaggcagcttatcatttatcctaagaagccatttcagtttgtataatagccttcttcagacaaattatcatctggctatt

SEQ ID NO: 394627 - DNA, 797 bp, Homo sapiens
cagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaagagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccgtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacc

SEQ ID NO: 394628 - DNA, 291 bp, Homo sapiens
ccacagggacctggtattttaggatcagggtaccgctggcctgaggcttggatcattcagagcctgggggtggaatggctggcagcctgtggccccattgaaataggctctggggcactccctctgttcctagttgaacttgggtaaggaacaggaatgtggtcagacagggtcagtgggagggctttggccattctgagccaacggtcctttgttagttggcctgaaagaagccatgacttagaacctgaagctgtcaggtggcaagaggccttagtcctggtgtttgat

SEQ ID NO: 394629 - DNA, 184 bp, Homo sapiens
aaaatgttttcttgtttattgatacactttcaactatagtaatcatatatattatgttggacttcattctttttttttttcgaatgcatttcccatttgcccttagaaatgagcgctagaaatgagctgcactttttttttctaaaagggaaatgggttacttcctcctcgctttgattcgctt

SEQ ID NO: 394630 - DNA, 273 bp, Homo sapiens
gagtgatagcatttataatcatgaaagatttaatacctggtaatgcaacaatagactgatagtttgctggcagatgtagtaatttaatgataattaagaaatgtattttatatatagattgtatagtatgatcccaatttggttaatatcacatactagtgataataattatttgagtgttctttttttttttttttttttgagacggagtcttgctctgtcgcccaggctggagtgcagtggtgccatcttggctcacggcaagctccgcct

SEQ ID NO: 394631 - DNA, 551 bp, Homo sapiens
acagagcctgacatcacttttctttatagaaaatgggcattcagcctgaaaccaccaagcagctcagagatgctaacatcctgaaggagagcaaacgctccatcagtagagaaagacaaaggcaatgtgctcaagctatcaggtttaatagaggatttggaggacagatctggaaatctcaacgctttttctagtgagccacaaaaggaaagaatagagagaatggaagagaggccatattttcagaaccgaaaacatgacgtctttgttaggctcaaagctttcaatgagtgccaagacaggccaagcaaaaatacacccaagagaaagagaaaacctcaaagccaccagaaagacaaggcagttcacccacaaaggcatgagaaccagacaggtatctggtttctcattagtaacactggatgcagcaagatggtgccatggtatttttcaaagcgctgagggaaggtaaatcaacacagaattctattctattccaaccagactgtcatttaagagtgacaaggacatttctgacatacagggactga

SEQ ID NO: 394632 - DNA, 243 bp, Homo sapiens
  misc_feature (1)..(1): n is a, c, g, or t
nttgggctggcgaagccagtgggaatgccacaaagacccacagcagattatagatttacggagaagaggtagtgggcaaggtctaggaacctctatccatctggaaatgtacctgctttatcaactatgaaaaatatgaatttacgtcctgaggtgacagtgagcttcaagtgcatttgcaggtcagttgtttggcaaaagtgtgctgagcagagaggtgtgcaggacataggccagggttca

SEQ ID NO: 394633 - DNA, 422 bp, Homo sapiens
aggattaagagtgccccacatatcactaaataatgaaacacaaagcatgtttcccccttgaaaaccacagttgcttttgttccaaatcatgcatccgaaattacccaaagtggaggtctaaacagactaacttcctcagatgacagtgccctttgagttggatgatacatatttaggaagtgcttaaaactgcctagaaatgcttagtcattaaagaaaaaactagggagggagcatacttgttgtttgtccctgggtagtttgacaggttaatccccatcttgggttcagaaatatccattcaccatccatgagtcctgagattaagtccagtttctgcttttacttagtctctgccaccactcaggtatgttggctgcaagacatcccacagaagagccagtaggcttaagcccctgggt

SEQ ID NO: 394634 - DNA, 471 bp, Homo sapiens
tcttcttcacatgtgctcatgaagagacaggtataagaatgagcaagctcaattgttaggagaacaagtagaaatacacatacatttttaaagcctctgcagttgttccatttgctgacatcttgctggccaaagcaagtcacatggccagtccttgtgctcaggtgggatgaactattaaaccacaaggtgtgcactcagggtgggccttaagtaaaattattaatactattaatttaccacaatgtataatatgctctgatgtgaaaagctcacaatccagtaaatatacacactgaagacagattgataaatgaggcatagttagtgaacactatggaatagcaaacattgaccagagagggaatatcttatataggaagtgtaagatatagagattatctcataaaaacaagagtcaaattatggattgaagatcagcagctttgaggaggaagagagagaaaataa

SEQ ID NO: 394635 - DNA, 296 bp, Homo sapiens
attaagcacctgctgtgactggccctgggctaggcactgtgggcacagaactaagatgcacccctttgctggaacagagagatgacgtcaacaagcatggggcagtgcaatgagagaggtgaactcagagaactggaggagcccagagaggggacagcttctgcggctccaagggaggtgtagtaaagaaggatatgcataggtggtcacaagggaactgagatggggaagatgaggctggatgaggcaagtggagagggggaaaagcgtgtgtgctctgggcacacattatggag

SEQ ID NO: 394636 - DNA, 491 bp, Homo sapiens
tggggccttggtaggcatctgggaacttggatattgggagggttcctaccaccacctgataagaatggctcaataagcccattcacacaaataatgtggtttatgccaaacacgtgcttcccttctgtgagcctggaatttgggtatgctccaagcagggggtgcctatgtgatcagcccccaaataaaaaccctagacactgcgtctcctacaagcttccctggttggcaacacttaatgtgcttttacaaggcactgctggggaaattatgtcttgtgtgactccacagggagaggcctcggatgcttacacctggttgctcccagatttcaccccgggcaccttgtctctctgctgagttgctgtagtaagtcacagctgtaagtaggattacaagctgagtcctgtgaatcctcccagagaatcatcctgcctggaatggtcttagggaccctcaacacaacagctcatgtctgagagtttattaca

SEQ ID NO: 394637 - DNA, 359 bp, Homo sapiens
agtccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgttgtcaacaagataccgtaaaattaagattatatatcacagtatgagttactgtctt

SEQ ID NO: 394638 - DNA, 184 bp, Homo sapiens
tccagatattctcaatttgactgcacattagggactcaggaagttaaaagcaaaagcaacaaaagatgctcaggcaccaccccacaccacctaaatcaggatctctgggggagcatgcttatgtttcaaaacctcccccaggtgattctaatagcagccagggttgacagcctctgttcttcca

SEQ ID NO: 394639 - DNA, 659 bp, Homo sapiens
ttgttttttaaaaacccaaggtatcagggtcttgctatgttgcccaggctggagcacaatggctattcacaggcacaatcacagctcactacagccctcaaagtcctgtgctcaagcaatcctcctgcctcagcctccctagtagctgggaatacaggcacaggccacagtacccaagttgtttaaaactggatgaaaaaattaaatgtacaagcaggatagggaataaagcaatgtttcataatattgagacatgtcgtaaactgggtctgctaacacttctcaaggtctatacattctctataagaatttttaaatgctgtgttttcatttcaaaattacactaaaacattagtataagcctgttctggatcatcgagatgcttccctagaaacacagagctgcccagagatttcacagcccacgtgtgctgttgtgtttaccatcaggctaaggccaaacaatacaattttaactaatttgtactaacaatcaagaacggagtaagacctgatccctgcataatatacatgccaagcgaagggcagaaggcacccctccaaggttttatagttctcagagaaaagtgatgagggaactgagttacctcatggcaaggtaacagaagccattgccaaagcctccaaatctgccacgg

SEQ ID NO: 394640 - DNA, 365 bp, Homo sapiens
ttttttccaaatggctcatcaaagtgaataatctcaaccatttttccccagtatcctagaaagtcatatcaatggtttgttgagacattttacatccaagtcaaattctggttgaatactcaaatcaagatggcctaaaaagggagataatgacaagcaagaatgaagagaaataaatgaatccagcaaaacaaacaaaaaaattcacttacaaagcctggcccagtaatgttccgtgtaagaaagggatgcaaaaaaaactcatgccaaatctaacactagccaaccgtggactagtagccaaccgtggactagtagccaaccgtggactagtagccaaccgtggactagtagccaaccgtgga

SEQ ID NO: 394641 - DNA, 305 bp, Homo sapiens
cagcatcttccaaattgtaccaagaatgatagttttgaaagatgttaatgggcgtgttgtgaaaaagagttctgtggttaaataagtttggggaaatgagagcaaagtcattaacacattgcacaggatctctcagtgccttaactactacacttagggaaatttcttaaagtgaggttaataagttgagttaggcaaacttatttgagcctgcaagactttttcaggcatatgtaattaacaaacatcccaaggataacactgcctggcttagagcatttctatatttatgtgaatatactgta

SEQ ID NO: 394642 - DNA, 270 bp, Homo sapiens
cccgtctggctcccctggtgttggttccgggggcccggctgcttcagggaagtccctttggcacagggattgtgttgcacactgaggggcgtgggcctcagcagctgctgccgggaagccggggcatccttaccttacccgccaaatgcacgggtcttcaccttgtgatttggaaacattcctgaactgtgctaattaggaagcttggtttattttttatttttatttttatttttgtagagatggggtcttgtgatgttggccaggctg

SEQ ID NO: 394643 - DNA, 612 bp, Homo sapiens
cccactttgtctttaggaatttattgattattccagctttacttgtcatagtggtgtctatttgcatctgtcctatgtaagtgcatctgtcctctttctccttgcaggtgcttgttttccctcacattttgactcagttcttggcaacctggttgctctaaaaataaagtcatgactttgaagttagtttggttctttcattgttgtcaggttaggaaccctattccatcccagatctccaaaacccagactttttggggggttgaaatgttaggctttctctttgaattgtagttttatcttctttcagttaccatttgcattttcataatgattaatgagactaagctttttttgtgtagttgactgtacctttggatttttttcccaaatacctttttatttcttcttttctttatggttttagaaaatgtagtttacataattgcagcttgatttgttactcagttaatggcatgcttaatggagagaaaaaatattaaatatatttccctttttaattactgtgcttttttcttttttaaggaaatgtttcattatgttaaatttcaatgttattctacttagctattccttaaatattataatatt

SEQ ID NO: 394644 - DNA, 506 bp, Homo sapiens
gggtaatttataaaggaaagatatttacttggctcacagttaaggaggctgggaagtccaagggcatagtgccgacatctgctcagcatctggtgcaggccttcttactgcatcgtcctatagcagaaaggcaagagagtacgcctgtgtgtgcacaagacggcagaatgggggatggggggcaaactcatactttaatcaggaacccactcccacaataagggcattaatacatttatgagggcacagccctcataacctaatcacctcttaaagtttccacttctcaacactgttgcattatgcattaagtttgcaaaacatgaactttgggggacatattcaaaccatggcattccctctcccctaaataaaataaagtaaaataacattgaacctgaatttgatcaagcctctagatctaattattaatttaccagaaatacaattcagaagaacatgttagattgacaccatgaggatatgattagcaaaatccagactta

SEQ ID NO: 394645 - DNA, 187 bp, Homo sapiens
cgtcgagttatctgctgctctggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggagcagcagggaaagaca

SEQ ID NO: 394646 - DNA, 329 bp, Homo sapiens
tgcatgtcatgcccaaggtcacacagcaataagtaagcagtagagcatgcctctgggaccattctgagatggtgagccacagcagtctactccccacccctcccctggccctatgccaaaacctgtccatgccctttgcacaaggcaggggcaagggtgaagagggaacaaacctagcagaggtttgctcaccctctgtccaaccctctgttctccaaccccctactaggactcaaaccacccctaggatggacgcatcctgcacacgggaaggcagaagagaaggtgcccaggaaccatctgagatgatacctattctaatcccaggg

SEQ ID NO: 394647 - DNA, 168 bp, Homo sapiens
ggagatggggttaggatgaataagtctccagattttattttgtgattctctaaagcctgtcctgttatttttttgtgagctgctaaacatcactgatagtaagtatggtgtaatggaaacagcatagaagtggagtttgatcttgttttgtgatctctagccttgtta

SEQ ID NO: 394648 - DNA, 618 bp, Homo sapiens
agatggagtctcactctgtcgcccaggctggagtgcaatggcgtgatctccactcactgcaacctccgtctcccaggttcaagtgattctcctgcctcagcttcccgagtagctgggattacaggcgcctgccaccacgcctggctaatttttgtatttttagtagagatggggtttcaccatgttggccaggctggtcttgaacttctgacctcaggcaatctgcctgcctcggcctcccaaagtgctgggattacaggtgtgagccaccgcgcccggccaattttttttaaatgtcttggcaagatggagtcttcctatgctgcctaggctgttcttgaaccattaaaatgatgtatttcaattatgtatatactatttatacatatattaggatatatctacatgtgtgtgatatgaatatatatacacattcacaagcacattataaatgtttgtatgtgtatatatacatacagtcatgtactgaataatgacatgtccatcaatgatggaccacatatgtgacagtggtcccatatactaccattttttttgttttgttttttgtttttgtgagacagggtctggttctgtcacctggggtggagtggaatg

SEQ ID NO: 394649 - DNA, 111 bp, Homo sapiens
agatatggttacctagtttaactaaaatgtcaagtttctttacttttaggtagagtaaggttaactctgtgtggttacagtggctctctcgggggcagataggttacttat

SEQ ID NO: 394650 - DNA, 467 bp, Homo sapiens
gcgtagacgtgcttatctgctgttgttttaaattttattggtaaaacctgcaaaaggagggctggcaggtcaggaaacaagctgagaggaccacaactgatggaaagagttgagcccggccctgggggtcactgaaggcttcctggacccggcgacctggtcttggataaaccttccctgtgggagggaagctaacagcatccagcgctggggaaagctgccgtgaccgagcacacgctgtggccgcacctgcctcctcactgccctaccaggtggaccccagcccctagcctgggcacgaggagcaaagggcacctccagcagggtgggcgctgccaggcctccaatgtctggctgggtgctgggaagctcctgacaggtgcgaggcaggagccagggacagctgtagaccccacgaggcacactaaggagtccagctgatgccgatgggtttgtgctccagactt

SEQ ID NO: 394651 - DNA, 145 bp, Homo sapiens
gcttaaggtcatggctttgaagaggaagggccaccgtgtgcctggacaagttctagtgtgtgaggaatgtcagccctgtgactctgctgtcacaccttggccatgtgacaaggctgtgtgagtgtgtgtgtgtgagacagagaga

SEQ ID NO: 394652 - DNA, 619 bp, Homo sapiens
actctgcttttgtaatggtttgactgatttttgatatttcgctaaaatgtaatgaatcaggattatacaaatatcttggtccttgactacgacaacccataaaagctaccaagctcccatttcttaaaagcacaaattgattaattaatacaaagggataacagcagtatgtgactgaatttaagtttttcccttagaattccttgaggaaagcatacatttctctactcaacataatatttatgtgttcaatcaagactaaaattgtaaaaattgggcaatggatctagttttggcaaattaggcaggtcctcacagcaattgctgtgtgggttgaaagaagagtgggagagcattcaattcattaaacactcctacagcattctatctttactaacaatcttgcagagaattctgcatctattcttattgctaccaacaatatacaatattctttaatacataatatttcatttctatgcctgctggcaaagctgcaaaaaacaaaaagaatgatatggtcaataaataatttctccagtcagaatattaatacaaactttcttataccttgcccttagatgaatgattcaatgcccaggaatataaactaccttgt

SEQ ID NO: 394653 - DNA, 546 bp, Homo sapiens
tgaaactgttttattaataaggaagtttcaacttcttgggaaccctttactttgaggcaaatacagttttcctggttcattattaaacttatctctcttttaaataccttgccaatttttgagagtggtggaaggtgtggaaagctctatgttctttagagtttgaagaaatatttattgtgttaggtatattaatagaaaattatttacttttcgtaggtgaaagtactgtgctataaaatgtctctccttttcaaaatttgcattatccatcattaattcaagtgaagtagtactttcaacatggaattgtgaaactgaagttgttcactttctatttagaagttacttctgttcaaggatatttctttttacctgttgcagaagagcatcttaatagctgccacatttgttgactattttctatatgccagtatttgcactagacattttacagatattcttttatttaatctttacaatagaacctttaaagggttattattgcatttatggctgacaagagtaaaactccaacagattaag

SEQ ID NO: 394654 - DNA, 387 bp, Homo sapiens
agccaccacgcccggcctccttacttgacttctatctgtgctcctcactccatcaggcagttgaagggacatcccttgaatactcgctgccttttccatggctgtctgtttcctttgtttgaaatacccttctaccttcctatctactggccaaatggatacctcttcctttcaagcccctgacatctcatgaaagcttccagaagcaccataccccacaacaatttctatcatttgcattattttcatgtctagtacctacatacaaccgaaacaaaagtttcatgaaacaatattactgtgcatgctataatctgatattttcattttcttctttttttttttgagacagagtctcactctgtcacccaggctggagtgcagtgg

SEQ ID NO: 394655 - DNA, 399 bp, Homo sapiens
  misc_feature (42)..(42): n is a, c, g, or t
gttggagtgtagtggtgtgatctcggctcagctcattgcaanctccacctcccaggtgaaagcgattctcctgcgtcagccacctgagtagctgggattacagatgcgtgccaccatgcccagctaattttttgtatttagtagagatagggtttcactgtgttgcccaggctggtctcaaactcatgggcccaaacagtcttcctgccttggcctcccaaagtgctaggattaccagtgtgtcactgcacctggctgactgcatcttttattatttttgcttgtagaatcttgctttccctttggttggagataggtcttatttatgtattattatcagggctaatcttttgaaaatcacttggctttatgggtgatggagacatttagaggccccag

SEQ ID NO: 394656 - DNA, 721 bp, Homo sapiens
taatcttcgtaaattttattttggcaccttttaaaaagcctgcaacaaaataattggttattaaatatagctgaaatcacttgttctgatttccaaaccccaagtcagtctgactgctcctaaccccaggttgagggcagcctaggatttcttctagagcttggcccagtgtccatagttcagttattatgaaatggattcaggctttatgtattttgacaatgtctatgttcaaaggaagatccaagtttggtgggtccttaagctcatacaatttggaagtctctcctttagaaaaagagtacgaaattataaatttaaaattgttggggctccaacagctgcagcttagtgcagagtaagccttggtagcctcatggtaagcccacctctgtctagatggcttttccctgtgtagtagacaccagtgaccgtggagctatcatcttctgttcttcttcttgtaggttgtttttcgctgctgctgcctaccttaaaggaaatgcaagctgggcaaaaatctaggtttatgtagcaggagaaaatggattttctgtcatttaaaagagatctgactaatgggccactcctgcataaagtcttgataaaatgtaagctgtgtggccatacgaaaaaagggtagaatttgggccgctttcttcaaacttaaaatggggatagctgggactcatatctgaaaagctctttcaaatcaacgctg

SEQ ID NO: 394657 - DNA, 336 bp, Homo sapiens
cgtttttcctgctacacagactggaggacaatatttaaaaataatccatgtctacaccctccccttatgatatgcagcctctaaatcatctgcttctgctctatgattattttgctgccacctttactttggtgcttagatgctggtgtccacctaagttaccttctctatcctgactagcatctgggttgataagcttggttgtcaacagaccaaagtcttggtcttgacctcacatggccctacaagctccgcttggttcagcatcagtgctgaagcctggacagcaacacttttctctggactaagttagagaggccggaacacagagtttat

SEQ ID NO: 394658 - DNA, 357 bp, Homo sapiens
gggggagggagcgagagcacactcagcactccctagtatgtcactggggttctggctggagtctaaatggaatgctccttactcttcatggaatatacattcccaaggagaacgacatgcaacaagtagctcaacaagcacagctgggatgggtattccgtggacactgggtggtgaatttcttcagatagtgtgatgagcatagactgacatgggccacactgaagcttaaacctgaaggttgaaaagtcagacatgcatagaccacatagaagaatattccaaacagagtggagtacagcgtgtgcacagggctcgaagtatggaatatttggcttgttcaaaggaatgaaagga

SEQ ID NO: 394659 - DNA, 180 bp, Homo sapiens
taaataaacaaattttaaaaattaaaaagaaaatacatgtgaacattttatcagtggtttgggaaaatatttgttaaacaaacaaaaatcacaatctaaatgagcaagacttgataatataaatttaaaactttagtaaacaaacaaaaaactaaaatcaaaatgctgtagcagcatcat

SEQ ID NO: 394660 - DNA, 597 bp, Homo sapiens
cccatgcccgacgtgtatccctcagttaactgtttggcatgggggactaaaagtaaacaagattggaatgtccctaggatggctatgaatggcatgttgccatagtatttcagaagccactggtaaagccctagatggataggatgagctcttggccacaaagcttttcttaggattttaatatactacaatttatcgtttactgggaacccaggtggagtgacttcatttccaagaacataggtgtccacgttaccacgattatttttttcagattaaggctctatcttctgaagggaaaatgaccactatgcttcactgaaagtccatctcaatcagaaagacaggcagataccacggaaacttagtacttacctgccaagcccaagacatcaagatgatacacattttgtgtttctctctgagggtaaaagaagaaggaaactgctgcaaagtaccaaggaatataacccggttataaaacagacagaacgagaaacaaatggcaaacccaagtgttgaccttcccattcaaccagaccacccctctgcttgctggaactaggagtagagaaaaaatacaaaaaaaggaggccg

SEQ ID NO: 394661 - DNA, 677 bp, Homo sapiens
attaaaagtctagaaaatatcttggtttaaattctgactctacccctcctagcagtgtgtctttaaaaagttaagtagccttactaaatttgagtttcttcatttgtaaaatggagatgagatcaaatttactgagttgtacagaatacaattaaatgagctaatgagtagtaaaacatttatcaccctactgagcgctcagtacatgccatatttcctctttcctcccatactttttaatttcgcacactagtttacacaatgtgagaaaaaagcttcctgtcccaatatttctttttctccatctctgccactctgccccatctcttcctgattattccatgtatcttttcattcccccaggcttttagttcatccttggccataacctactctaaacttgctcccacacgttccctctctggctttctccttgcctctacagtcccaggagcagagcagcctaaattttaaaacaccccatctgagttcccattgtccaccacatataataacagtgcatgcctattgccttatgtgtctctctctcttgctgattatcctcaaagacagtcttattcattgttatctccagaaaccatcacagtaagaaattctaaataagtattaaagaattaaatgtgatatcacactctggggactgtggtggggtcggg

SEQ ID NO: 394662 - DNA, 665 bp, Homo sapiens
atccatgaagtcatgcttcacttatgcatcattcagaaaacacttcttggatactcactactcatgaatatgcatgcatatgacttgcagtcaaagccatgagttctcaatagcaaaactgttccagatatactcagagagttaaaatgtttaaaaaacttttttttaaagaaaattttccttttatttttgttgttttgttttgtttttttttagaagcaagatctcactatgttgcccaggctagagtgcactggccattcacaggcacgattatcactcacacactatggtcctgagatcctgggctgaagtgatcctcctgcctcagcttctcgagtagctgggactagaggcatgtgccactgcacctggcttagagtataaatttttgtgtcacacaagatatgaagaacatgcacaggcactggacccatctgtgggttcatctttctgtgggacccactaagggacccatctttctgtgaaaaagtcacaagtgaagtcctggccaggaattcaagaccaggctgggcatcatagtgagacctcatctctacaattttttttttaaaggaattggcttctagtcaatgctttgtcaaataccagtcttgggacattagatgaagctccttcatctaatgtttttctaatacataaaa

SEQ ID NO: 394663 - DNA, 240 bp, Homo sapiens
gctttttcaagaccgcctgttcactcagcctggaggttttaaatctccttctactatcaaacagagactatggaggagggtgaggaggaaaagaaaggggcaacaggagcagatgcttcaaaaagtgctagggacacggaaattaagaactcaggagaatgaaaacctatgcagtcaccacactcatgggtttttaaagagaatctgtttcaggccctgcagttagacttcaggtggtag

SEQ ID NO: 394664 - DNA, 274 bp, Homo sapiens
gccctctctcacacccctgggacttagcttttaactctcctacttccttggttttaaccaacttctcttggacccacttcaaatgctgcctttgtttactcatttaatggtcatacctcaccctgtgagggtctgtggatacaaagatgattaaggtatgatctttggcctcgaggagccccaacctgttgaagagagacaggcacatgagggggctcatggcagatatactgaacacagagggactcttaagtgttctgagactgattctgga

SEQ ID NO: 394665 - DNA, 596 bp, Homo sapiens
acgccaaggcgccggcgggcccggctcctcacctactgggggccacctgggcccccggagcccgggagtcgcgggctgaggtcggcctggggcccacgagccgccctcagcgtacctgggcccgggcctcgggagtgttcgcattagatccccgaggagggtctggtttatgaagatcccgttgccgcgcattcattcatttgttcactcttcattcactccccaagtcctgcctgggcgcctgggccacgcctttggctaggcattaggggaaaaaagcaaaacagacaaaaacaaaacgtagggcataaaagcacgcgtaaagtgcttgacatgaggcctggcaagtagcaaacactcagcaagtgctacgtgttgcacacgtgcgtgcgtgtgcacgggcaaaccagccttgggggtcgttggttcattcattattaagaaacaggggcccctgcctaactgcactgttttccagccagtgggtccacccttgggttttggccccttttctagctgtgatttcagacaagcgactttccttccctaagccttggtttcctcacctgtgaataagacaaatatgtcataacgcg

SEQ ID NO: 394666 - DNA, 370 bp, Homo sapiens
ttcacagatagacttggttatctttggggggtcagaaccccagtggtcaaatccccaggaggcaggaggcagagtactttgcaatacacttcatattcccaagtgtaagtaggtcatgaagactacaacagtgcaccctatctttatttttatctttttcttttgttcactctagagttcctaagaatcactgggtagattattaaatatgcagatcttcggaccttgcccctgcagattctgattcagcaaatgtggcatgggacctggacagccagggttttagcaagcacaccaggtgattctgatgccaattacatgcaaccacacctgaccaccgtcgcccataatcacatgcaaagaattgcta

SEQ ID NO: 394667 - DNA, 401 bp, Homo sapiens
acgcgcttgattgcctccagtcatgaccaggacgtgtcctgactctgagcttcgaatccaagaggccagctctgggtcaccatctcacagttgcctcctggccctgccatcctagtcacaagatggctgccaccggctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaa

SEQ ID NO: 394668 - DNA, 165 bp, Homo sapiens
ccagcccacacctcctcctgccttgctgtcacagcagtgacatttatttacccaaatgacgcttgctggccttgagtgccaaggagacagcagctgcttccgagtcagaggcccaaaacggcagcgcacatggtaggcactaacagacgtgtattccactgaaaa

SEQ ID NO: 394669 - DNA, 322 bp, Homo sapiens
attttgactatggtatcaggaagggaagaaaaggagaaacttaaaatatggacaggaatacagacacttcagcaacagtcaatgtcctctgcagacagtacatacaatattattcacaaagtgggctaactctgtaacagtcttccagccaagagtctctgaaaattatttctaaaactttacaacttgctactataagggggaggtacgcaaccaataagtctaattaggattctgaccatttctcatatgcaaaggcatatcaacaaacccatctgcagtgtacagctcatcctcatctgggatctgggggcacaattta

SEQ ID NO: 394670 - DNA, 351 bp, Homo sapiens
tgcagatggaagtttctgtctgctggccctcaagagagtgttttgccagggacacagtctgttcctcctcagaaaacaccccccaaatgctaacaacatccccaccagctgctagaagcccctttcccctccccaccttgaagtagctcatagttctctgggcagagccagaccatccagtgtaccccagaggccagtaggttcctgcccattttcctctctggcttcctgccaagaattatggcagctgaggatgaatggagaagtaaaaacaactaacaccgcacaactaacaactaacaccgcagttcccacctgggttccacttagcaggagacatttcggagggtt

SEQ ID NO: 394671 - DNA, 813 bp, Homo sapiens
gtaatctatcaaatatttaactaattgtacacaaactgttccaaaaaattgaagaattcgttttagcaggtcagcataatccttatattgaaaccagataaagacagtaaaagaagagaacactactaggctgggtgcagtggttcatgcctgtaatcccagcactttgggaggctgaggctggcgaatcacctgatgtcgggagttcaagacaagcctggccaatatggtgaaactctgtctctactaaaagtacaaaaaattagctgggcatggtggcgggcacctgtaatcccagctacttgggagactgaggcaggagaatcgcttgaactggcagcaggaggttccagtaagctgaggtcacgccactgcactccaggctgggcatgacagagcaagactctgtctcaaaaaaaaaaaaaaaaaacccagaaaaaaacactacacatccatttcatctcatgacataaatgcagaaaatttaaacaaaatttaactaatcaaatcaccaatattttaaaaggatgtaacaagtggagtatatcccaggaattcagggttggtttaatactgaaagagcaataaatattgttcattatgttaacaaacttaaaaagaaaacctatataatcatctcaatagatgcagaaaaagcatttgacaaattctacttccattcctaacaaaaattctcagtaaactaggagtagaagtgagctctttaacctgacaaaagatcatctatgaaaacttacagagtgtcacacttaatggtgaaagacagaatgctttcctttataagatcaggaa

SEQ ID NO: 394672 - DNA, 480 bp, Homo sapiens
tctcatttatctggcagtggcatattccatctctgcagcaaggtaaagccctgggtgctagaagttccttcacagaacctaggtgtcagccagtcatggatattgtcctgtggcttcccataaagaaagctaaatctttgcttcgtgctactcctgagcatgcagttttgatttttgtggttctccatctcaaaacaaaagctgatgggctgactgggcctttctttgcgctgggggaatattaaaaactcggtttttcaaatattaaggtacatggagccaggtggaacccaggctcttttaaagattgatgagggcaggtgcagtggctctcgcttgtaatccgagcactttgggaggccgaggcaggcagatcacttgagaccagaagtttgagaccagcctggccaacatggtgaaaccccatctctactaaaaagaaaataaaaatttgccgggtgtggtggcaggcatctgtta

SEQ ID NO: 394673 - DNA, 454 bp, Homo sapiens
ccatgcccagctaatttttgtatttttagtagagatggggtttcaccatgttggtcaggctggtcttgaactcctgacctcaagtgatccacctgcctcggcctcccaaagtggtgggattacaggcgtaagccaccatacctggcctcttaaattgatttattggtagaatcaactttttttcaatgttatctggataaaagtttagattcccacaaatttcacccatttcattctaaaggttgtgaatatattgtttaaaaaacccagtttttcttttttgagacagggtcttgctctgttgcccaggttggcagtgcagtggcacgatctaggctcacagtaacccccacctcctgggttcaagcaattcttgtgcctcagcctcctgagtagctgggattacaggtaggcgcacaccaccatgcctggctaatttttgtatttttagtag

SEQ ID NO: 394674 - DNA, 527 bp, Homo sapiens
acatgatgttttttttttaattcccactgaattaaaaaacctaggttaaataactgaaaactccttcaatacaacctctccaaaacaatttcaaattaagtagttcagcttttagattctgaattcttcccccactgctccacaaaattttaaaggaaactaggtataattctgacagtatagctgttgacatattaaaatttgttttttaacacaaacatcttaatttatttactgttatctgtattttcactttcaagtttaatggtggctctaagacatttgttaaaatgtaacaatattttgaaactaaatgttgatttttatttctgttacatatgagaactgcctgtgtatttctctattatttgatggcataaatttatatttaagtgataagcagttgagttatctgaaaaacaaattttggctataaattatgtatttgaaagcatgaccataaaatatttttcaccactaacaatgattttatttcaagaattccatgaggtgtaattaatgtattg

SEQ ID NO: 394675 - DNA, 736 bp, Homo sapiens
ccaggaactaggccccacctccaccatctctagggaggaggggttggaagaataagatcagggtcagggcacttggagcctccttcctgccgctcacggctccaggggccatggcatggacgggcctgtgctgcccagctcggtggcccacgctggagactgtggatgggcagtagactggcctagcgatggttccatttccaagttgcatctctcactagccgttacccgggcattgcacttctctccaggacagtttccctggctgtaaataggactaaggacgaggtccagctccgctgcttatctgtgtgccttaggaacagccatttaattacctcatctctgggctcttgggaggaacatggcaggttttgaagcacttagcgccgggctagagtgaacatccattcaataatgtggctcccacctcttctaggttaatacagaggccacccggttcatctcagacctgcctttgtccaccaggggtttaagtaaaaactaccacaagcagcaagacttccaccgtcctctgggtcccaaccacaatcctgaggccaatggtgacggcaactgtagagacagaaggtagcagttcctttcggacacttgtccaccaacccaagaatggagcaaaaatcaaaacctccctccatacatcttcttaacggactctacttcctctccattcccactggctctgccccaagttaagcctctgcagagctcctgg

SEQ ID NO: 394676 - DNA, 467 bp, Homo sapiens
ggaaggatattaaagacccctcgaaaacctcctcatgagatgaaccaaaaggagttagaaacattgctgaaaacattttcagttaaattcctaagatttttccacaaaaattggtcaattatacagtcttacagacaaaaaaaaaaaggatgaagcagcttcagattacaaagcccttttagaaatactatttgtaaaatattctagccttgaattacaataaggagtatttcctgcagggactgaaaatgcattaactgttttataaaaggacttcatctcaaacttagtagcctaatttaaaaaacataaatcaggatgggaagttacagatatgattgaattgctggccttagttgaacattagagaggactctacagcaagaaaaaatcccagaaagctaacaagcatatgtttttccaattacaacaattacaagaacatagaccaaagggaccttcttgtt

SEQ ID NO: 394677 - DNA, 575 bp, Homo sapiens
cttattggagctagttagttgcaacatttacaaatttcaggtggattattatctttgtttccaacttttttctattccaagaaattatggtatgcttccagttgtggcttatccttcctgacgtaattttacttactcacaagaggcacaacctccttcattcactataagctgtgtccttatgattatgcagtcaaaaaggcatccatgggttttttaaattgtccacacacattgtatcaatgtttcatgtgtcctcccaaaggaattatgaaacaaatgtcaagccctgctttaatacatttttttaaaatttccccaaacactgattttacgtttctgatctcttagagggatgtatcatggaagaatcaggacttcaagtggaataggctttgttccatgataccttaccttttcaaagttgaaagacacatcatatttctgtcctttgcataaaaaagcaataaatgtctttttcccagaacaaacattgttctatggcttttcttaagaatggctggtggtgctgacgccgaagtcgctgttgcgtcacaaactggccgtttcgaccc

SEQ ID NO: 394678 - DNA, 235 bp, Homo sapiens
cttttcagccttgtgaccttatggtgattcaaacagaggcttcatcaaaggcagattcagaaatgaacttggtgtgtgtaggtggttatgcttgtcattattgtttgtaatagtatgatagggatgatttcagtgtctgccaacagggaactggttgaggttaagtaaactgtggtacatccaaatgatgcatactgtgcagttgaaaagaagaatgagaaagacctctgtactc

SEQ ID NO: 394679 - DNA, 376 bp, Homo sapiens
ctcagaaggcagggaggcaccacttgaaatttctcccccggagatgacatgagcagagagccacacagaagccgctgaccgtggctgaccaggccaacagccctgcccctggccacctttctccaggcttccccaccctccctctgtgtgccagccaccatggccagcttctagtgccctcactatgctgcttcttgcctcaaggtctctcttttatctggaacattgtcttctatactttctctatcttaattcctgttcaaactcctgagtacaattcaaatctcacttcccagcccaggtttagtacccatgtgatatccactcccacagtaacctacaatggtgtatcagttaactgtcaacttcctgattc

SEQ ID NO: 394680 - DNA, 429 bp, Homo sapiens
aacaccagttttactcatgaaggggcattttctaggtcaaatttatgatggggaaaattaaacctcaatccacgacagagtctttattcaaataaggtgccttttaaaagagtctctcatttctcctgtttcacagaaaataagacctgacctcaagaaaacacctttcatgagcctgggcaacacagcgggactctgtctgaaaaaaaaaaaaaaaaagacgggaatgaatctcatcagttgagaaagaggaggaaatgaagggaaacatcccaggataaaataagggggcatagggaaagatctccaaactatttattggtaggcatctaaacagctggctttcgggtagtgtcccctgggaccagccgcagcgggtaatgggtacagaaatccaaacttccgggctcccaatcttagacttctcca

SEQ ID NO: 394681 - DNA, 245 bp, Homo sapiens
ctagaagaggcacacgtggcagaaatacaagcagacggcagaataaatagcatcaatgaaaagagtcaaactttgtaaaacatttgaagagattcattctgagtcaaatatgagtgaccatggcctatgacccagccctcaggagacccagggaaaatgtgtgcaaggtggttggacacagctgggttttatacattgcagggagacatgagacagcaattaaatacatataagatatatattgg

SEQ ID NO: 394682 - DNA, 375 bp, Homo sapiens
cctggctgcttaatcaggagaggcagtttgaatctgagatgaggtgagatgagggatatagctttgtagctactgaccagagtcaactgagtacccaaaaggagtactgattccccaatcaaaaagtctgtttctcatggcactttagtatatgaactcagaagaatgtttgcaatatgtataagaaagggttataacatataagatgctcttgaaaattatcatgacagtgattaacatttcatttaaaaatgggcaaagaacatcaactgcgcctggactacaagtatatgtcttgatttccaaacttttaagttaccttttaatggatttgggagtcttacggcatggtagtcatgacatatctgctgtatg

SEQ ID NO: 394683 - DNA, 463 bp, Homo sapiens
acctggggccttatccgacatacactatattaggtttttagagggctatgactatctgcaaaaggaaaattcaagataccttgttataaacatggtatacagtgacctttggcatgcattttgttttgtaactacacgaagtgttaatttggattgaatctttgttttcacttgaaaaccttttttttttttttaagaaatagcttggaaatttaggctgccctgaggtgttttcgtgtgtctgtttatggttgacaagtatctagttatgagaagaaaatgtggatagaattaactgtattataggcgagaagggaattgccttataatcttgtgccactgaacacaagattagtagaagagtgggcttcacttgtgactttctgggtatttgtgattaggcgtgtgccagttggtctttgcttgggcattagctttcctcatatttgagaaggctttcacg

SEQ ID NO: 394684 - DNA, 393 bp, Homo sapiens
cctaggtaactgcaacaatgtatttaggtaatttacattaggtttttagagggctatgactatctgcaaaaggaaaattcaagataccttgttataaacatggtatacagtgacctttggcatgcattttgttttgtaactacacgaagtgttaatttggattgaatctttgttttcacttgaaaaccttttttttttttttaagaaatagcttggaaatttaggctgccctgaggtgttttcgtgtgtctgtttatggttgacaagtatctagttatgagaagaaaatgaaggaagaaaaggcaggcaggcaggcaggatttattagtttcctgacttacacattgcttctaatcatgtaccactatccacagctagtcacgctgctgtgca

SEQ ID NO: 394685 - DNA, 681 bp, Homo sapiens
cgtgttggcgggtgcctgtaatcccacctactcaggaggcagaggcaggagaatcactcaaaccccagaggcagaggttacagtgagccgagatcgcgccattgcactccaaccagggcaacaagagcgaaactccatctcaaaaaaatatatatatatatcaacaataatccctactactggagttaacagattactgcaggttacaggtagggctctgctgggaagaacaaagcaatcagaatcacagactgatgaagctgtccctactataaaagtcccaagcaaaaatgctccaatactgtatcctctggatctccctgagccgttaagggggagaaaaagtcaggtaagcagctgtaaagttatgtctaaatcatttgtgcacatgataaaatcatataggtgagcgatgaccattttaaaaatgttctagtctgaagcaaaaggaactacacagctcatgattatctagggtttaagtgcttttcttttttcttttttttttttttgagacagagtctcactctgtctccaggatggagtacagtggcgtgatctcagctcactgcaacccgcgcctcctgggttccagcaattctcctgcctcagccttccgagtagctgggactacaggagtgtgccaccatgactagctaatttttgtatttttagtagaga

SEQ ID NO: 394686 - DNA, 447 bp, Homo sapiens
aagcggagcagatattgctatgctagtctgggaaatgagccttcttttctgagacggagcctcgctctattgcccaagctagagtgggatggcatgatcttggctcactgcaacctctgcctcccgagttcaagcaattctcctgcctcagcctcctgagtagttgggattataggtgcacgccaccatgcctggataatttttgtattttttagtagagatggggtttcaccatgttggccaggctggtcatgaactcctgacctcaagtgatccgcccgctacggcctcccaaagtgttgggattacaggtatgagccaccaagccctgccaacttggaagtcttttagttgatttttctgtgttttctagcagtacaatcatatttgcaaagagtgatgattttaccacctcttttatttttttttttccatagaaaatatctg

SEQ ID NO: 394687 - DNA, 220 bp, Homo sapiens
catacagcaagttttcaaagaaaataatattctattaaaatgatacctttaagacctcaaatatttctcctctggtatgaatgagaaaatgctgggggagggaggggacaataaaccatcaggaagaaaagacaactggcctttgtcagtcttgaatactataaacaataacaaagtatagactaacaataaatttatccactgagaagggtggtaagat

SEQ ID NO: 394688 - DNA, 469 bp, Homo sapiens
aatttccccacgtgcattagctgtagtcaatcatattagatctagggcagccctcggttgctagtcgtgggaagggcattctgcaagtgtctaaaaccgcccgcaaagcagtgggtaaagcagcggcctagagggggcatggctgtcccacgccaaacagcgtattagccgcaaaaccaggtactggctgaacctcagtttgcgtcttcgctccgccgccttctggagtcctttctgcccctagaggacgcaggtgagctaagcagcagtcatgccctttaccatcatgacgcccgcaggcgggaccacccggcactgtagacagctgccctttacaatcatgactcatagaaactacggcactctggccgtggccgacgttgctcctccgaagcatggcgccggcgggagttgtaacccgggctgtccggagcggggagctgcccctcacaagcatggcgtcagctga

SEQ ID NO: 394689 - DNA, 189 bp, Homo sapiens
tgtaagtaccttcactcaaatatgctggggctcagtaggagaagcaaagagaaggaaaaggtattgattgatcgatttgattctaagcagagattgacagagataagcttctaagacctttcaggccccagagtgtgactgttgagcacctaagaagacctcacttgacccgtgacttcccgccagagc

SEQ ID NO: 394690 - DNA, 320 bp, Homo sapiens
gtcatttctgtttatttgttcactgtttggttccagctctgctatgcatctgtttactctgttctggcatagacatgagtttctcagtgtgaggtcagtgaaagccacctcatcagagagagcatgtgaggggcccgcctgctgccccccacccccagctggggtccaccctctgctctctctgcgtgtttcatggggctgcctgtgaggccgtgtgaaccagagcccggctgggaagccacatgctgcctggactctgacctttcctggcagcatgaccttagccaatacgcccaacatggcagtgatgcccaacatgg

SEQ ID NO: 394691 - DNA, 276 bp, Homo sapiens
gaaccttagactctgacttctcttatttagccccttctgaggctatttcatgcaaggcatgtgcaaaagtacaattgagaatgacaagcaaagggtcctggcttctagggctccagcaaacaatgcaccagaagaaattaagcctatatacaaatgcctataattctcacatcactatattctatgtgaactatgaaatggagtattaatgattcataaaattctaccttcaatccagaccactctcctcagtgccagctgcatcctgaaccattg

SEQ ID NO: 394692 - DNA, 154 bp, Homo sapiens
catgaacagtcaccatgccctctctgccccgtgccaccagcatcctgagacagccctgtggaatcagtaagaggagaggggctgggcgcagtgactcatgcctgtaatcccagcactttgggaggccaaggagcactttgggaggccaaggaga

SEQ ID NO: 394693 - DNA, 350 bp, Homo sapiens
  misc_feature (341)..(341): n is a, c, g, or t
catggccatcctgtagggccaaggtgatggaaggggccttatccgtctggaaacttttccactgattgtggcagctgctgtatgtcatgagagcctaagaacccacaaaaaagagaaaggaccatagaggagatctttgagtctaaatgttgaatttggggcaagccttacatttgcagtcctcaggttgccaactcctttgacaatgactccgattttttgttgtggcacctgatttgctgtggtgataggaggcaagaggagttggggaactgggagaggatggttgagccttgtgatgagaggaggggttttattttatcttagtcttttcagaatgntgctgaatt

SEQ ID NO: 394694 - DNA, 372 bp, Homo sapiens
taaacagcaataagtcattagcaaaaaaataaagtgagaaatgtgcattaaaatgatccacatttatttaagaatgtattccaatatcaaacagcaaatttcaaaaatgcaaaaacgcaattgcttttgcctctcaggtacatcacttgacctttctagttctcacccacttcacccctaaaatcggaaaatctttctgcaagaaaaaaatttgaccacattcccttaaggcctcttccaatttcaagagctgtgctttaccatgacaaaaagaacctagctcttttcccaattttgcaacgtcagaaaaaggaggaaggggaaatagctgtgtttaaaacattttttaccaaatagaaatattataagatt

SEQ ID NO: 394695 - DNA, 407 bp, Homo sapiens
tttccactcccgtctgtcaaagttgggtggagaactcccacatttcctgttctgagcccggagctctctgccaggtaaagcaatagacactccagcttgtgctgggacagctgggaccatcggagggccgggcactcacgaagtttcatatcattctttctaggttagttctgatgaaatcaacaccctgaactgaaggccccgggcggccaagataaaagattaagtcatcaaatgactagcatacttgcttcttaacaagcaactcttgtggttgtcatacacgaatgacgtcatctccaacacacaccttgtcaggtattctattcccaattttctcacagctgaaaaggaaccagactgctgattttctcaatttgcttagcagaggcagaaatttaattggg

SEQ ID NO: 394696 - DNA, 1074 bp, Homo sapiens
gcatcatatcccttataaaaatgcatccagtaggttataatcttgggggaaatgccacattatttagcttcattttccccttcaagtctttcacattgttcaaagcagacagcaaagtgaaagcattattttgggagatggggaaaagccagaatagattattggcaagaaatagaaaccacaagatgaggatcaagagtcaaggtccaggtttagacaagatctctggatgtggttattatgccacagaatcatcaaatgtcaactgaggttttaaatactgcttaaaaatgccaagcctggaaataggtgcctgtaattcttcagtccttcagtaaatacccaggctattaaagtaggtaattcccaggaatgaaatcctccttgcacctctcttaggggtggccatggaggacacaaaacacagatatttatctttggaagaaggaggtagaactgtttttgaaaatatatataaagtatagttgtgttggagaagcagaggcatttttgaaactatatgtataattagaatggtatgtgaatatatatacaaccaaagacaaaggggtaaaatggggtaaaaatctactattattcactatacggcactcattctcaactaccttctcagatctaaactctacttttctgtagagaaccccttccctgtggttaggacagggccaacactgacttgccaccatgacgacatcagtgggtacatgacctagactcagcaaattatgctacccataacatcggctaccatgatcatttaagatctggacatgaaatctaaactaggttctccctggacattttctgaaaggtattagagagtgggtgtagtggctcacacctgtaattccaacattttgggaggctgaggtgggaggattgcttgagcccaggagttcaagaccagactgggcaacatagggagaccttgtctctatgaaaaacaaaaaaattagctggaggccgaggcggacggatcatgaggtcaggagatcgagaccatcctggctaatatggtgaaacccgtctctactaaaaatacaaaaaagttag

SEQ ID NO: 394697 - DNA, 375 bp, Homo sapiens
atagagattccttaaatgccttgaactactaagtttctcagcctttgccaaacagttccctgtgtgtgtttgggcacaccttcagcactctggtagattacaactcttagccttcacttcccatttatgtagaacctcaaggacagccagatgagagattaggagcttcttaggtccttcttgggaatgcacacagtactgcacatttttagattccgagggatattttggagttttaaaagctccctagggacatctcattatccagatttttcttttaaagtttttaattaaactcttgtttacctgatatgtattgctgcatcaggcagttgtgatgttaagcagttgccactgattttatttgacagatgc

SEQ ID NO: 394698 - DNA, 496 bp, Homo sapiens
agccagcccacatgattgcagaggggttaccatttcctccatgtcttagatcctggagatggcacgtcgggtcctctttttctccagttgaccaccagggaagaaaacaaaagagctgcatgttagcacaaacttcttgcttcacttcaacgaacagggctgagcaatacctgggaaaagtacaattccagagtaatatctggaggcttgtctctagactggtggggaagggtgctggctctagcttattgtttcccaagctttcctgataaggatcacctggcttgcttgttaaaatacagattattggggctaggaatctgtttccttaacaagcgttccaagccattcctgtcttcaggcaagtttgggaaacattctgtctactgtaccaaaaatagcctgtggaagaggagtgcttttaagcaagtttagttttgcacatagtacatgaataggttctccttgtttgaaaatgttttaacattgcagagaa

SEQ ID NO: 394699 - DNA, 296 bp, Homo sapiens
gggaatcgaagaccaggtaaagggaagcaggttagagaagggcagagaagtgagggcctgctgagcagaaccagccaaagtaaatggaggagcagctggagtgggatgaaaaggccatgaggcatcttgcagatgggtcctgccttatgcacacccgggttcagaagctctcccaggctgactctccccaagcattcagtttggttccatttaagacatgcatactgaatactatcacgaattagcactatgctgtaagctgaagaaacaaatgcaaatgagacacaactctgccc

SEQ ID NO: 394700 - DNA, 236 bp, Homo sapiens
ctggaagaatctggctgttctttcacatcttataggtcaaatccaaaaaacaaatagttactcaacaaacaggtcctgggtgctagagggtctgccctctccagccctgaggtttgtctgtgtttttcccctactgtatccccagcacctacaacagggcctagcatgtagtaggtgctcagtaaacactgccaagtgaatgaatgttgctaagtgtggatgctgcagaagtaaca

SEQ ID NO: 394701 - DNA, 456 bp, Homo sapiens
cgggtgcgctggctcacgcctgtaatcccagcactttgggaggccgaggtgggtggatcacaaggtcaggagatccagaccatcctggctaacatggcgaaaccccatctctactaaaaatacaaaaaattagctgagtgtggtggcagacacctgtagtcccagctactcgggaggctgaggcaggagaatggcgtgaacccgggaggcggagcttgcagtgagccgagattgtgccactgcactccagcctgggtgacagagcgagactccgtctcaaaaaaaaaaaaaaaaaaaaaagaccatttgcaaagggggcctgtgctttcaaaatggaaagaaaattagacagtagtttcttgaggggagggggatgtggtactgttttaaaataagttaaactactgaggagcacagaggaacagaaagaaaaaaattcttatgttccagctcaga

SEQ ID NO: 394702 - DNA, 407 bp, Homo sapiens
aagaccagcctgggcaacatagtgagaacccttctctactaacagttaaaaaattagccagatgtaatggtgcatgcctgtattcccagctactggggaggttgaggaaggagaattgcttgagcccagaagttggaagctgcagtaacctacgattgcaccactgcactccagcctggacaacagagcgagaccgtgtctcaaaaaaacaaaaaccagttaattctgtctccgcacagtggttccagatgggccgcgtcttgcaggagactttgagatttctagtaatttcttcctaggtgagattttctttttagggatttagtaacttcactgtctggttgatatgtgcaattagtgtggcatcctggtctttgggtaggggctgagttacctaggcttccctt

SEQ ID NO: 394703 - DNA, 408 bp, Homo sapiens
ctttctgacctcattattaaggatttggtgtgaaaataaagacagaaaaaatgttaaatgtgggaactggaagacacttgccttttctatctgctgtaacgactcaagttggagcccataagctcctgcaaaatgcaattataggatatatgcactgaattctgcaaaatataaggagtacaaagagcacgtgaagaaggacaaaaatgagattaaaatagtttttttttttttgttttttgttttttgttttttttgctattatcaagccaatgtacatgactgaagaccctgagtcagcattgtctacaaaaagggcatggcttatgcgagatccacatttggagctttgagaatctcctgttgctcaccactgtccaatgcttcaaactgaaattctctccatga

SEQ ID NO: 394704 - DNA, 706 bp, Homo sapiens
gttctgaggtgttctgggcattcatcactggttcctggtctgtgagagaaccaccaagcccttacgtagggagaaaaacagaggagtctgcacctggcttctccagactccttgctgtgagacagccacaggctgtgatacatatctttaactttaatgcagttgctatatgaaacctttttcctgtaatgactgtgtatttgcaagcactatctctaggtcttctttaacaattgaactctatttaactgccacttagaagtaggagtgttgcccaggcctggtggctcacgcctgtaatcccaacactttgggaggccgaggcaggcggatcacgaggtcaggagtttgaaaccagcctgaccaacatggtgaaaccccgtctctgctaaaaatacaaaaattggctgggtgtggtggaggcgcctgtagtcccagctacttgggaggctgaggcaggagaatggcgtgaacccgggaggtggagcttgcagtaagccaagatcgcgccactgcactccagcctcggcgacagagcgagactccacctcaaaaaaaaaaagtttctgtgacaacatgcattggagaactacaaattagatcctcagaattgacctttgagggagacacagagatcttggccctattttactcccttagatcagtttcctgctccagaccaccgcgaggggtaccagctcgatcg

SEQ ID NO: 394705 - DNA, 229 bp, Homo sapiens
ccgaagctcagtctcctaatccttttcaagcctttaaggtttctattcttaaaagaaagtcatatgctaaaatgtaaatacacaaaacagagattgtttgcatagtccaccaagagtccacatatttcctaaaatgtatacaaaattataggttgtatatatagatatgtatttaataagaaaggagtccaaagattttatccaattctcaaaggggtcaaaaacccac

SEQ ID NO: 394706 - DNA, 224 bp, Homo sapiens
ttttagagagtggaaaaatggagtatgacatatagagtgtgggggtgattttaatagattttgtaagggaaagaagcacaggaccagttgttgggtgagttagaaggtgaaagggagaaacatatctgcaatgactttctcacttttgtcttggacattccagaggatggtgagattattttctaggagaagacggaggaagacaattttggaatgggagatgg

SEQ ID NO: 394707 - DNA, 216 bp, Homo sapiens
aaagtgtaaagcagctatgtttcttgatttggatgttagttccatgggtgtgttcagttttgaatatgcatatactttgtggtgtgttcaagttttagtatcatattatatagttcaacttgaaaagtaaaaatatttgtgggatctaaaaaatcaaattagagtagaaagagagttaccagaggctgggaaggggagtgcatgataggcgggggg

SEQ ID NO: 394708 - DNA, 433 bp, Homo sapiens
gtattcactggtgtcttaggatcacttaccaaaaatctgtggcatcttagatttggtaacaaagcctaaatatttccatcctacaaacgtggtcatgcttctaaaaaaccacatgaagtagctcaagatgtttggccagccaatgcgcagaagccctaattgaacatgtaaaaggcagatgagatgtgttaaggtattatcttagatacagattatgtggagctcaaagaccttgttgggaacaacattttctaattgcgtttcttctccgtggatctgcgcttttttgaaatcaaaagacactaggggctaggcaaagtggctctcacgcctgtaattccagcactttaggaagccaatgctggaggattgtgtgagcctaggagtttaagaccaaactgggcaacatggtgaaaccccatatctgccaaaa

SEQ ID NO: 394709 - DNA, 190 bp, Homo sapiens
tgctggattacaggcgtgagccactgtgcccagctgcctgaattgtttttgactccccatagtactgtgtccttttaggagagtttttttgccactgattctcagttgtttgggtgattgcttttctgtgggtgggaggaattgtcctagatctctttgagggtcttatgaaagtttttgacagtttcta

SEQ ID NO: 394710 - DNA, 692 bp, Homo sapiens
ggtgggaaaagtttctagtaccagataaagcttcaaacaattttgaaaggccctttcaaataattagttacatgattctgtaatttgatattccctgggatttgctctggccttggctttgtctgcacatgcctcctaaaacctttgttaatcatataagaatgatagctaatatttatctgagtacactgcctcatcgatctaatctaatccctatgacgacctacggagatagatactattatctttgttttatagatgaggaagctgaggcctaatgttaagtaattcccctgaggactcagtcctgggaaattaaagagagcaggattagactcaggtctcagatgccatcatcgttggtcttaaccattatcccatattttatattaatcaaaagacttgtaaatcttgggattcgaatcagtggctaggcttgtgtttgtacagttgtaactgatggaaggacagcacatacaatcttacatagattgaaaaaaatttctctcccccccaggaagtgtctttcatttgggactctggaaggaaaactggagggggcatgagtatcaggtggaaaatttcacactgttaacaaatagacacctttccttaaaccgtatttgagtttgcagcaaagccattctatattattcttaagcctgtcctatttatagcatcaccctgattgc

SEQ ID NO: 394711 - DNA, 425 bp, Homo sapiens
attagaggatccgatgacaggcaggactgagtgacacaatcacagctgactgcagcctcgacctctcgggtggagcaatcctcccacctcagcttccccagtagctgggaccacaggtgcatgccaccatgctcagctactttttaaacattttttttggagaaacagggtcttgctatgttgcccaggctggtctcgaactcctgggctcaagcaatcctcccactttggcctcccaaagtgctgggattccaggtgtgagcccccacacccagcctgaaggttcttcttctgtaagatcctgagtagtggcatcactgccctggggaccctctgttgagaataatattcatcacaacctccctggcccagaatgacactgcagggcactgttcccctaagcccggtcctgcctgggtccccat

SEQ ID NO: 394712 - DNA, 276 bp, Homo sapiens
tgtttttcttccttctcaaggatctccattcctggtcacaatagttttcatgtatttgcatcataatattcttaatatgcctactccagcataagccccttgagaacaattcagcagagggatgtttttggcagaaaaggggcttctgcagatgcaatggaggggaggaggggagagaacagttaggagcctgctttcctcctccagcaagggtttcatggcaagagctgttgtatgtcagagttttcttagattgttagttttctgctttggttg

SEQ ID NO: 394713 - DNA, 354 bp, Homo sapiens
cagcctcccgagtaactgggattctaggcgcctgctgccatgcccagctaatttttatatttttagtagagacggggtttcaccatttggccaggctggtctcgaactcctgatctcaggtgatccacctgcctcggcctctcaaagtgttgagattacaggcgtgagccactgtgcccagccttctatgtgtattttctcacttaatttttatagcaaccccgtggagggtactattactagtgtgagacccattttccaggtgaagaaactgaggcatagtgagttgaaatggtcatggtagtttctggtgtggatgggctggtggctgaggtacccgaaggactggcctgg

SEQ ID NO: 394714 - DNA, 225 bp, Homo sapiens
caggctgagggcataccacggctcatgagcaaggatccaggaaaatagaggactcaggaagaacaggctggggctcatctcctccactaaaatgggagctccctgaggcaagacccatgtttcctccaaccaaccagtgggttgtcgagtgcagcactgtgtctcctccatcaggacagggagctgccaagggcagaggccatgactccttcctctataaaccca

SEQ ID NO: 394715 - DNA, 479 bp, Homo sapiens
ccccttgccttccccccaaaatctgtgacgttcttcccaccaaaggctgtggtagccccgcttcctggacactgtggggcagggaaagagggaattctggaccatggggtggaagacttgagttccaagcagggctctgccactaaccatctagctaaacaagtcatgaaacatctctaagtctcagttttctggcctcaaaaatggggataccaacacctactgctaggatgggataaggagcaaacgagaggacgcaaaagcactttataacacaaattatggagttactactacgccccatctaagatctgagctgtccctcagataagttaattcagaatctctgggagtggaacctggacattgccattcaaaaaaattctccagaaaactccaatgcaaatccaagatcagcaaccagtgataaaaatctgaatatggggctgggtacagtggctcacgcctataatcccaga

SEQ ID NO: 394716 - DNA, 247 bp, Homo sapiens
tgtcaccgctcgtcctctgccattcctcccagcacagcccgccgtgtcactgtgtcaccgtgtcaccccactgtcaccactcgtcctctgccgttcctcacagcacagcctgccgtgtcactgtgtcaccatgtcaccccactgtcactgctcgtcctctgctgttcgtcccagcacagcctgccgtgtcactgtgtcaccgtgtcaccccactgtcactgctcgtcctctgctgttcctcccagca

SEQ ID NO: 394717 - DNA, 415 bp, Homo sapiens
ctcaagtgaaacagtaatcagtcccatgagcagcacccccagcctattcctatactttatgatatttgttcaaagtcgagcacttaaatagccagctgttctaatctttgtggactgattccatgatgggtaacatcaggagtatcagcctggtgtgaaggcttaaggtcttgttgaccttttctgtgtttgtatattcactgggcctatgtgaacacttttccccagattcctggaatgtatcagtgcttttagctgccttgatctaagagtggcatgttagatgttctgttgtgttcctctgccctttgtcttttgtccctctagcactggcagatcggtgacatccctgtagctctcaactaagccactcctcccatccgaactttgcatcaggtgaaacagtaatcagtcc

SEQ ID NO: 394718 - DNA, 181 bp, Homo sapiens
agggaagatgctccaaggaagtgacattaaactaggactgaagggatgaatagatgttggtgaggcaaagtgtgtgtgtgtatgtgtgtgtgtatgtgtatgtgtatgtgtatgtgtatgtgttgcacaggtgtatgggagttcagagtgttccagtgaaagggaacaatgcccaccaagg

SEQ ID NO: 394719 - DNA, 190 bp, Homo sapiens
tccacccccaactccccagcactatcccacctcaatgcctggctcaaatccttcccttcaggaaatcttcaggccctactagaggtgattgttctttctagaacttttatgtcacttctcacggcttctataatgtggcataacattctgcattgtgtgacaaggtacgtgtacatattttattttccct

SEQ ID NO: 394720 - DNA, 222 bp, Homo sapiens
tcttagataacttccatcactccccttctttaagccgcactgcttgcttgcccagacacttctgtcctgggtagtgtggaaaataaaacaccttttgtacttcggttgagggtaggtggattggagggagagtcctgtatagtgtcatgctgcctctgtaatagaggacttttagaattttttcagcagtagacaaatacgcaccttctttcccagccttcc

SEQ ID NO: 394721 - DNA, 348 bp, Homo sapiens
tgtgtctggaatctattccttctggtggattcgtagtcttgctgacttcaggagtgaagccgcataccctcgcaattccctaaatagcctcacaagatgatcattcctttccataacctctaagagaagatctaagaaggagctatgaaatcaaagaccaaagatctgactcttctgtgagtcactctgccctctacagtgactgttcattacttaattttacagcctagtgttggggtctgccttcaaatgttctgtgtcgtgtccaacacactttgtcattttctttctaatccttgtgattattattgttgttattgttagcttcctatgtaaaactagttctca

SEQ ID NO: 394722 - DNA, 517 bp, Homo sapiens
tctaattcaacaactaagaacaatatggcttctcttgtatggaaaatctgagctgcacttcaggaagtacttcttatgtaccttcttatcctgggtaaaagtcccgtaggttggttaatactcatgaagacttaaaagattgctttttgaaatgccatctgtcaacctcttgatgtcagtataacctgcaattcttcttaaaatacaattcctgctgacctaaggatacctggaggtgtccactaagtctctccaggtgctttaagatctggcatgtgggagcaagaactagttaattactcattattggtccagaggttagaactgagacaaatcaataaatggtaaagaaaagtagtttgagcttgaataggaggaaattctgtggcaattatagcaatcccaaattagaatttttttatacttttggaggttctatcatggaaatactcaaacagttagaatgtcaagaatgtagtaggggtgggacgggtggcccatgcctgtaatcccagtg

SEQ ID NO: 394723 - DNA, 193 bp, Homo sapiens
ccagtttacatgagggttagcaagaaattatcctttcctagtattaaagagtatttaatcaacctcttccagttatctgacaaaacaaaaaaaactcagtaatgtcaatgataaatcagtacttttttggggatatgagtaaggtgaggaacaggaagaaatgttgcaaactactttacttttagacaaatta

SEQ ID NO: 394724 - DNA, 189 bp, Homo sapiens
ttaatatgtttactcttttcattagttcagtggtataaaccctggcaagtctcataatttgtaattaatagagaccaaaatatggtcttaactatattgcagtaatctagttttcccttctctaataagaattcttactgtttcctggccttccctggaaaggtgttttttgtttgttttggcttttgt

SEQ ID NO: 394725 - DNA, 470 bp, Homo sapiens
tgaggtgactctacaggatcttctgctgctcgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttg

SEQ ID NO: 394726 - DNA, 728 bp, Homo sapiens
ggggctcaggggtccatcaaagcccatgtggcctgaggcgggcagcgctgcctgcacttttctggaagtcctctcctgaggctggcttttgctacttccaagtctcggatttcctcgtgtcgattcccttcagcggtaaggccctcctctcagtctagcacctggcagccagttctacccccagtgcaagcctgattcacgatgattttcactctgcagataaagctgtcagtgtggttggcagggcgccatctgcctggatgagcacacgacaggaaagctgggctctcggtcagtctcccctacaggggcagggtaaaaagagaggtgttctagggagtatttccaggtctgtcctcaaatgccccaagtcacaaggtcgcctcattgggcagccgtcactaacccaaacagtaagtgtcatctatatgtctgtttcccagagtgccccctgggtcacagaaaccacccgttttcttatgggatgtgcttcttatcctccttggttgggatagatgcgaatttacacagagcttaaccagctccagcatctttcctggcccccgtgtcacactctgttgcctgccagaatacctgatgcatggttttcctctaaaattgctacttttgtgcagagggtttcccacgcacccatgtgtgactttcagtgactaagaaaaaggccgtggtcctggggaagaaagtggatgctcactgagagattgtgt

SEQ ID NO: 394727 - DNA, 217 bp, Homo sapiens
acgtctacacctaccaaggtagtgctgtccctctgcaatttgaacctaatacccaccacgctgtgtttcatccagcaggcctgaccacggagttcaccatgtctgggtcattggcatgttgtgaaataaatacactcacggctccctaagaatatccaatatttagcaaatattttactttgatatgcttgatgttcttggtagcacacaggaactt

SEQ ID NO: 394728 - DNA, 434 bp, Homo sapiens
cctcccaaactgctgtgattacaggcatgagccactgcgcctggcctccatgctacttttatcattggtatttctgcacctagtctgtaagacagtcgtgttatgaaaaaagtcatctttggaccagagtagggagacctgaattcatttttttagtttatttgtttattataaaggatattatataggatacagatgaagagatgaatagggcaaattatgggggaaggggtatggagcttccatgccctccccaggtggccactgtccaggaacctccacctgtttatccatctggaagctcagagacccgaattctaagcctggctccagctttgtggccttgtcactctgagtgtctgtcccttttcctgctttattattcttcctggcattatataatgcatttgtttactatctggcttcccttctgg

SEQ ID NO: 394729 - DNA, 318 bp, Homo sapiens
acatggatctcagagcaccagagcaggaggggacgagacagggtccgagtcccacctctcaagacaagagcaacctgggcctcctgccacggagccccacacacccttttcatcaaagccttgtgacaggctgatgggcacccaaggacttgccgttttcaagaggacatagtgggatgggaggtcacctgcccacttggatgacaggtggtgagagaaccagccgggctgcgccaggttttctaacacatcctggagtcacatgcagacccagagccgtgctgccacccagccagggcagtcccccttggctctcca

SEQ ID NO: 394730 - DNA, 159 bp, Homo sapiens
aacaaaggcttgtgggtaggtgctgcttagcacaagattcctccagacagaaggggaagctgcatgcttgctgtgtttgctgtctggagcttcagggatggcttgccagtttacttctgtttctcacctgaggtttttggtatataagacggtatcttg

SEQ ID NO: 394731 - DNA, 251 bp, Homo sapiens
cttttttttttttttctttctgtagagacagggtcccccatgttgtccaggctggcctcaagcaatcctcctgccttggcccccaaagtgctgggatgacaggtgtaagccactgtgcccggcccaccattggtttctctctgtggcctgtttctttctatttttttttaatcttttacatgaaaaatatactttcaaaaaagctgcaataaaatccacataaaaaatttaccatgatcttgtttgaaagt

SEQ ID NO: 394732 - DNA, 498 bp, Homo sapiens
cttgtctctgccaattacccccctgagtccttgggtaagtaacatcacccctgtcagcctcagtttgtttgcctgcagtgtcagatggaatagcacccagactgtagcatacaagggagagcagcatgattgtggatgccccacaattccttggtgtgaggagagaaatatttgtaattgtcagaaacatgatatagctggcagaagtatatgaaatcagttacataaattgtgaactacatctcaaagttctattagttctgagacagggtgaaaatcagcgcatttctcatcaggatagaaaataaaaacagaaaaaatcaggagccattgggaataattcagcctcagagagagttcagtgccttcatcggtagtctttggggtgctcgtagaaccaccattgttcatctccacacttgctggctccatatcctttgatgtgtatgtacctttctgacccttttttagctgcttagtaggttagctggggttgac

SEQ ID NO: 394733 - DNA, 442 bp, Homo sapiens
gggcactgatgaccataaaatgaggctgtcaacagcttgctgctcccctgtgtagacagaccaggattaaatcggcttcaagacacccatccaagcgcgggtgcaataaaaggctctgaggatggagcccaggcgctgaactttggggtgcagttttaatttcgctggacaattcttgggcttctcttacagtgcacccaagattttacagacaaaaaaggctgcagagatcaaattccagcttcccccagttacttaaccactcagcctgggaatgttactaaacctctcaaggctcttccttcatctttaagtggcagtaacagctatgatggagaggatttggaaggggggaaagagaatgcatgaagagagcttagagcacataagaagtgctcagtaaacatcagttattgcctttttaccattcgtaactctagaa

SEQ ID NO: 394734 - DNA, 281 bp, Homo sapiens
cttcacacgtggctctcatgacacctccagggccactacccctggtttacagctgaggactcgaggcacagaagctgagcggctccccctggccccagagcagtgggtggaggagcctctgacccaaggacagagctgcatgaaatccaccttctgcatccacaaaatccagcaggatgtctggcgcaccagacgtgcttagttgctctcagttaatgaataaaaactttaaatttagcctgtttaaaatagtgttaagtggaccagaccctctagggtta
